(12) United States Patent
Andre

(10) Patent No.: US 10,760,089 B2
(45) Date of Patent: Sep. 1, 2020

(54) MATERIALS AND METHODS FOR INCREASING THE TOCOPHEROL CONTENT IN SEED OIL

(71) Applicant: BASF PLANT SCIENCE COMPANY GMBH, Ludwigshafen (DE)

(72) Inventor: Carl Andre, Raleigh, NC (US)

(73) Assignee: BASF PLANT SCIENCE COMPANY GMBH, Ludwigshafen (DE)

( * ) Notice: Subject to any disclaimer, the term of this patent is extended or adjusted under 35 U.S.C. 154(b) by 157 days.

(21) Appl. No.: 15/525,768

(22) PCT Filed: Nov. 13, 2015

(86) PCT No.: PCT/EP2015/076608
§ 371 (c)(1),
(2) Date: May 10, 2017

(87) PCT Pub. No.: WO2016/075313
PCT Pub. Date: May 19, 2016

(65) Prior Publication Data
US 2017/0335338 A1    Nov. 23, 2017

Related U.S. Application Data

(60) Provisional application No. 62/234,373, filed on Sep. 29, 2015, provisional application No. 62/079,622, filed on Nov. 14, 2014.

(51) Int. Cl.
| | | |
|---|---|---|
| *C12N 15/82* | (2006.01) | |
| *C12N 9/02* | (2006.01) | |
| *C12N 9/00* | (2006.01) | |
| *A61K 31/202* | (2006.01) | |
| *A61K 36/31* | (2006.01) | |
| *C12Q 1/6895* | (2018.01) | |

(52) U.S. Cl.
CPC ........ *C12N 15/8247* (2013.01); *A61K 31/202* (2013.01); *A61K 36/31* (2013.01); *C12N 9/0071* (2013.01); *C12N 9/93* (2013.01); *C12Q 1/6895* (2013.01); *C12Y 114/19* (2013.01); *C12Y 114/19003* (2013.01); *C12Y 114/19006* (2013.01); *C12Y 602/01003* (2013.01)

(58) Field of Classification Search
None
See application file for complete search history.

(56) References Cited

U.S. PATENT DOCUMENTS

| | | | |
|---|---|---|---|
| 5,627,289 A | 5/1997 | Jeromin et al. | |
| 6,303,849 B1 | 10/2001 | Potts et al. | |
| 6,689,880 B2 | 2/2004 | Chen et al. | |
| 6,733,974 B1 | 5/2004 | Feazel | |
| 6,740,488 B2 | 5/2004 | Rangwala et al. | |
| 6,818,807 B2 | 11/2004 | Trolinder et al. | |
| 6,825,400 B2 | 11/2004 | Behr et al. | |
| 6,893,826 B1 | 5/2005 | Hillyard et al. | |
| 6,900,014 B1 | 5/2005 | Weston et al. | |
| 7,423,198 B2 | 9/2008 | Yao et al. | |
| 8,999,411 B2 | 4/2015 | Froman et al. | |
| 2015/0299676 A1 | 10/2015 | Walsh et al. | |

FOREIGN PATENT DOCUMENTS

| | | | |
|---|---|---|---|
| AU | 2011289381 A1 | 1/2013 | |
| WO | WO-93/10241 A1 | 5/1993 | |
| WO | WO-94/13814 A1 | 6/1994 | |
| WO | WO-95/27791 A1 | 10/1995 | |
| WO | WO-96/24674 A1 | 8/1996 | |
| WO | WO-98/55631 A1 | 12/1998 | |
| WO | WO-98/55632 A1 | 12/1998 | |
| WO | WO-99/64616 A2 | 12/1999 | |
| WO | WO-00/18889 A2 | 4/2000 | |
| WO | WO-01/059128 A2 | 8/2001 | |
| WO | WO-02/26946 A2 | 4/2002 | |
| WO | WO-2002/052024 A2 | 7/2002 | |
| WO | WO-2003/078639 A2 | 9/2003 | |
| WO | WO-2003/089452 A2 | 10/2003 | |
| WO | WO-2003/093482 A2 | 11/2003 | |
| WO | WO-2004/071467 A2 | 8/2004 | |
| WO | WO-2004/087902 A2 | 10/2004 | |
| WO | WO-2004/090123 A2 | 10/2004 | |
| WO | WO-2005/007845 A2 | 1/2005 | |
| WO | WO-2005/012316 A2 | 2/2005 | |
| WO | WO-2005/083053 A2 | 9/2005 | |
| WO | WO-2005/083093 A2 | 9/2005 | |
| WO | WO-2006/008099 A2 | 1/2006 | |
| WO | WO-2006/012325 A1 | 2/2006 | |
| WO | WO-2006/024509 A2 | 3/2006 | |
| WO | WO-2006/069710 A1 | 7/2006 | |
| WO | WO-2006/100241 A2 | 9/2006 | |
| WO | WO-2007/096387 A1 | 8/2007 | |
| WO | WO-2008/022963 A2 | 2/2008 | |
| WO | WO-2009/111263 A1 | 9/2009 | |
| WO | WO-2010/023202 A2 | 3/2010 | |
| WO | WO-2010023202 A2 * | 3/2010 | ............... C12N 9/00 |
| WO | WO-2010/066703 A2 | 6/2010 | |

(Continued)

OTHER PUBLICATIONS

Wu et al. (Nature Biotechnology, 23(8): 1013-1017; Aug. 1, 2005).*

(Continued)

*Primary Examiner* — Vinod Kumar
(74) *Attorney, Agent, or Firm* — Marshall, Gerstein & Borun LLP

(57) ABSTRACT

The present invention relates generally to the field of molecular biology and concerns increasing the tocopherol content of a plant relative to a control plant, comprising expressing in a plant at least one polynucleotide encoding a delta-12-desaturase, at least one polynucleotide encoding a delta-6-desaturase, at least one polynucleotide encoding a delta-6-elongase, and at least one polynucleotide encoding a delta-5-desaturase. The present invention also relates to methods for the manufacture of oil, fatty acid- or lipids-containing compositions, and to such oils and lipids as such.

11 Claims, No Drawings

Specification includes a Sequence Listing.

(56) References Cited

FOREIGN PATENT DOCUMENTS

| | | |
|---|---|---|
| WO | WO-2011/006948 A1 | 1/2011 |
| WO | WO-2011/161093 A1 | 12/2011 |
| WO | WO-2013/049227 A2 | 4/2013 |
| WO | WO-2013/153404 A1 | 10/2013 |
| WO | WO-2013/185184 A2 | 12/2013 |
| WO | WO-2015/089587 A1 | 6/2015 |

OTHER PUBLICATIONS

Wells (Biochemistry 29:8509-8517, 1990).*
Guo et al. (PNAS, 101: 9205-9210, 2004 ).*
Ngo et al., (The Protein Folding Problem and Tertiary Structure Prediction, K. Merz., and S. Le Grand (eds.) pp. 492-495, 1994).*
Thornton et al. (Nature structural Biology, structural genomics supplement, Nov. 2000).*
Keskin et al. (Protein Science, 13:1043-1055, 2004).*
Smith et al. (Nature Biotechnology, 15:1222-1223, 1997).*
Bork et al. (TIG, 12:425-427, 1996).*
Doerks et al., (TIG, 14:248-250, 1998).*
Nishimura et al. (Plant Cell Physiol., 41(5):583-590, 2000).*
Yang et al. (PNAS, 98:11438-11443, 2001).*
McConnell et al. (Nature, 411:709-713, 2001).*
Hanzawa et al. (PNAS, 102:7748-7753, 2005).*
Wishart et al. (JBC, 270:26782-26785, 1995).*
Lee et al. (Mol. Cells, 24:301-306; Published 2007).*
Abidi et al., "Effect of Genetic Modification on the Distribution of Minor Constituents in Canola Oil", Journal of the American Oil Chemists' Society, vol. 76, Issue 4, pp. 463-467 (Apr. 1999).
Arondel, et al., "Map-based Cloning of a Gene Controlling Omega-3 Fatty Acid Desaturation in *Arabidopsisc*", Science vol. 258, Issue 5086, Nov. 20, 1992, pp. 1353-1355.
Bai, et al., "X-ray Structure of a Mammalian Stearoyl-CoA Desaturase", Nature, Aug. 2015, vol. 524, pp. 252-256.
Bligh, et al., "A Rapid Method of Total Lipid Extraction and Purification", Canadian Journal of Biochemistry and Physiology, vol. 37, Issue 1, 1959, pp. 911-917.
Browse et al., Fatty acid composition of leaf lipids determined after combined digestion and fatty acid methyl ester formation from fresh tissue, Anal. Biochem., 152(1):141-5 (1986).
Cahoon et al., Biosynthetic origin of conjugated double bonds: production of fatty acid components of high-value drying oils in transgenic soybean embryos, Proc. Natl. Acad. Sci. USA, 96(22):12935-40 (1999).
Cutler, et al., "Abscisic Acid: Emergence of a Core Signaling Network", Annual Review of Plant Biology, vol. 61, 2010, pp. 651-679.
Database EMBL [Online] 5, "Rattus Norvegicus clone CH230-506F12, Working Draft Sequence, Unordered Pieces.", XP002754369, retrieved from EBI accession No. EM_HTG:AC142370 (Mar. 29, 2003).
Database EMBL [Online], "Mus Musculus Domesticus DNA, Bag Clone: B6Ng01-175K07, 3' End.", XP002754370, retrieved from EBI accession No. EM_GSS:GA003396, created Feb. 6, 2011).
Datar et al., Cell and Cell Debris Removal: Centrifugation and Crossflow Filtration, pp. 472-503 IN: Rehm et al. (eds.), Biotechnology, Second, Completely Revised Edition, vol. 3 (Bioprocessing) edited by Stephanopoulos, Weinheim, Germany: VCH (1993).
De Block, et al., "Transformation of *Brassica napus* and *Brassica oleracea* Using Agrobacterium Tumefaciens and the Expression of the Bar and Neo Genes in the Transgenic Plants", Plant Physiol., v.91(2):694-701 (1989).
Dolde, et al., "Tocopherols in Breeding Lines and Effects of Planting Location, Fatty Acid Composition, and Temperature During Development", JAOCS, 76:349-55 (Mar. 1999).
Domergue, et al., Acyl Carriers Used as Substrates by the Desaturases and Elongases Involved in Very Long-chain Polyunsaturated Fatty Acids Biosynthesis Reconstituted in Yeast, J. Biol. Chem., 278(37):35115-26 (2003).
Domergue, et al., "In Vivo Characterization of the First Acyl-CoA Δ6-Desaturase from a Member of the Plant Kingdom, the Microalga *Ostreococcus tauri*", Biochem. J., 389(Pt. 2):483-90 (2005).
Dubos, et al., "Integrating Bioinformatic Resources to Predict Transcription Factors Interacting with Cis-Sequences Conserved in Co-Regulated Genes", BMC Genomics, 15:317 (2014).
Focks, et al., "Wrinkled1: A Novel, Low-Seed-Oil Mutant of *Arabidopsis* with a Deficiency in the Seed-Specific Regulation of Carbohydrate Metabolism", Plant Physiol., 118(1):91-101 (1998).
Fujiwara et al., Seed-specific repression of GUS activity in tobacco plants by antisense RNA, Plant Mol. Biol., 20(6):1059-69 (1992).
Griffiths, et al., Delta 6- and Delta 12-desaturase Activities and Phosphatidic Acid Formation in Microsomal Preparations from the Developing Cotyledons of Common Borage (*Borango officinalis*), Biochem. J., 252(3):641-7 (1988).
Hull et al., Analysis of the promoter of an abscisic acid responsive late embryogenesis abundant gene of *Arabidopsis thaliana*, Plant Sci., 14:181-92 (1996).
International Preliminary Report on Patentability, International Application No. PCT/EP2015/076596, dated May 16, 2017.
International Preliminary Report on Patentability, International Application No. PCT/EP2015/076630, dated May 16, 2017.
International Preliminary Report on Patentability, PCT Application No. PCT/EP2015/076608, completed Feb. 28, 2017.
International Preliminary Report on Patentability, PCT application No. PCT/EP2015/076605, dated May 16, 2017.
International Search Report and Written Opinion for PCT Patent Application No. PCT/EP2015/076596, dated Mar. 11, 2016, 15 pages.
International Search Report and Written Opinion for PCT Patent Application No. PCT/EP2015/076605, dated Feb. 24, 2016, 13 pages.
International Search Report and Written Opinion for PCT Patent Application No. PCT/EP2015/076608, dated Mar. 9, 2016, 13 pages.
International Search Report and Written Opinion, International Application No. PCT/EP2015/076630, dated Mar. 7, 2016.
Jain, et al., "Identification of a Novel Lysophospholipid Acyltransferase in *Saccharomyces cerevisiae*", J. Biol. Chem., 282(42):30562-9 (2007).
Kargiotidou, et al., "Low Temperature and Light Regulate Delta 12 Fatty Acid Desaturases (FAD2) at a Transcriptional Level in Cotton (*Gossypium hirsutum*)", J. Exp. Bot., 49(8):2043-56 (2008).
Knutzon, et al., "Identification of Delta5-dehydratase from Mortierella Alpina by Heterologous Expression in Bakers' Yeast and Canola", J. Biol. Chem., 273(45):29360-6 (1998).
Li, et al., "Correlations between Tocopherol and Fatty Acid Components in Germplasm Collections of *Brassica* Oilseeds", Journal of Agricultural and Food Chemistry, 61:34-40 (2013).
Livak et al., Analysis of relative gene expression data using real-time quantitative PCR and the 2(-Delta Delta C(T)) Method, Methods, 25(4):402-8 (2001).
Meesapyodsuk, et al., "The Front-end Desaturase: Structure, Function, Evolution and Biotechnological Use", Lipids, vol. 47, Issue 3, Mar. 2012, pp. 227-237.
O'Malley, et al., "An Adapter Ligation-Mediated Pcr Method for High-Throughput Mapping of T-DNA Inserts in the *Arabidopsis* Genome", Nature Protocols, vol. 2, Issue 11, 2007, pp. 2910-2917.
Okayasu, et al., "Purification and Partial Characterization of Linoleoyl-CoA Desaturase from Rat Liver Microsomes", Archives of Biochemistry and Biophysics, 206(1):21-8 (1981).
Okuley, et al., "*Arabidopsis* FAD2 Gene Encodes the Enzyme that is Essential for Polyunsaturated Lipid Synthesis", The Plant Cell Online, vol. 6, Issue 1, Jan. 1994, pp. 147-158.
Paul, et al., "Members of the *Arabidopsis* FAE1-like 3-Ketoacyl-CoA Synthase Gene Family Substitute for the Elop Proteins of *Saccharomyces cerevisiae*", J. Biol. Chem., 281(14):9018-29 (2006).
Qi, et al., "Production of Very Long Chain Polyunsaturated Omega-3 and Omega-6 Fatty Acids in Plants", Nature Biotechnology, vol. 22, Issue 6, Jun. 2004, pp. 739-745.
Quek, et al., "Commercial Extraction of Vitamin E from Food Sources" The Encyclopedia of Vitamin E, Eds. Preedy, et al., CABI Publishers, Oxford, U.K., 2007, pp. 140-152.

(56) References Cited

OTHER PUBLICATIONS

Riekhof, et al., "Lysophosphatidylcholine Metabolism in *Saccharomyces cerevisiae* The Role of P-Type Atpases in Transport and in Broad Specificity Acyltransferase in Acylation", J. Biol. Chem., 282(51):36853-61 (2007).
Ruiz-Lopez, et al., "Successful High-level Accumulation of Fish Oil Omega-3 Long-Chain Polyunsaturated Fatty Acids in a Transgenic Oilseed Crop",Plant J., 77(2):198-208 (2014).
Ruuska, et al., "Contrapuntal Networks of Gene Expression during *Arabidopsis* Seed Filling", The Plant Cell Online, vol. 14, Issue 6, Jun. 2002, pp. 1191-1206.
Rychlik, et al, "A computer program for choosing optimal oligonudeotides for filter hybridization, sequencing and in vitro amplification of DNA", Nucleic Acids Research, 17(21):8543-51 (1989).
Sarkar, et al., "Specificity Determinants for the Abscisic Acid Response Element", FEBS Open Bio, vol. 3, Issue 1, Jan. 1, 2013, pp. 101-105.
Shanklin, et al., "Desaturation and Related Modifications of Fatty Acids1", Annual Review of Plant Physiology and Plant Molecular Biology, vol. 49, Jun. 1998, pp. 611-641.
Shanklin, et al., "Stearoyl-acyl-carrier-protein desaturase from Higher Plants is Structurally Unrelated to the Animal and Fungal Homologs", Proc. Natl. Acad. Sci. USA, 88(6):2510-4 (1991).
Strittmatter et al., "Purification and Properties of Rat Liver Microsomal Stearyl Coenzyme A Desaturase", Proc. Natl. Acad. Sci. USA, 71(11):4565-9 (1974).
Stymne, et al., "Biosynthesis of γ-linolenic Acid in Cotyledons and Microsomal Preparations of the Developing Seeds of Common Borage (*Borago officinalis*)", Biochem. J., 240(2):385-93 (1986).
Tamaki, et al., "LPT1 Encodes a Membrane-bound O-Acyltransferase Involved in the Acylation of Lysophospholipids in the Yeast *Saccharomyces cerevisiae*", J. Biol. Chem., 282(47):34288-98 (2007).
Tang, et al., "Oleate Desaturase Enzymes of Soybean: Evidence of Regulation Through Differential Stability and Phosphorylation", Plant J., 44(3):433-46 (2005).
Vilardell et al., Regulation of the rab17 gene promoter in transgenic *Arabidopsis* wild-type, ABA-deficient and ABA-insensitive mutants, Plant Mol. Biol., 24(4):561-9 (1994).
Wang, et al., "Crystal Structure of Human Stearoyl-Coenzyme a Desaturase in Complex with Substrate", Nature Structural & Molecular Biology, vol. 22, 2015, pp. 581-585.
Wu, et al., "Stepwise Engineering to Produce High Yields of Very Long-Chain Polyunsaturated Fatty Acids in Plants", Nature Biotechnology, vol. 23, Issue 8, 2005, pp. 1013-1017.
Xiao, et al., "Characterization of the Promoter and 5'-UTR Intron of Oleic Acid Desaturase (FAD2) Gene in *Brassica napus*", Gene, vol. 545, Issue 1, Jul. 2014, pp. 45-55.
Akermoun et al., Complex lipid biosynthesis: phospholipid synthesis, Biochemical Society Transactions 28: 713-5 (2000).
Bafor et al., Ricinoleic acid biosynthesis and triacylglycerol assembly in microsomal preparations from developing castor-bean (*Ricinus communis*) endosperm, Biochem. J., 280(Pt.2):507-14 (Dec. 1991).
Banas et al., Biosynthesis of an Acetylenic Fatty Acid in Microsomal Preparations from Developing Seeds of *Crepis alpina*. In: *Physiology, Biochemistry and Molecular Biology of Plant Lipids* (Williams et al. eds.) pp. 57-59. Kluwer Academic Press, Dordrecht (1997).
Bates et al., Acyl Editing and Headgroup Exchange are the Major Mechanisms That Direct Polyunsaturated Fatty Acid Flux into Triacylglycerols. Plant Physiology 160: 1530-1539 (2012).
Bernert et al., Analysis of Partial Reactions in the Overall Chain Elongation of Saturated and Unsaturated Fatty Acids by Rat Liver Microsomes. J. Biol. Chem. 252, 6736-6744 (1977).
Blombach et al., Acetohydroxyacid synthase, a novel target for improvement of L-lysine production by Corynebacterium glutamicum, Appl. Environ. Microbiol., 75(2):419-27 (Jan. 2009).
Broadwater et al., Desaturation and hydroxylation. Residues 148 and 324 of *Arabidopsis* FAD2, in addition to substrate chain length, exert a major influence in partitioning of catalytic specificity, J. Biol. Chem., 277(18):15613-20 (May 2002).
Broun et al., Catalytic plasticity of fatty acid modification enzymes underlying chemical diversity of plant lipids, Science, 282(5392):1315-7 (Nov. 1998).
Brown et al., Synthetic promoters for CHO cell engineering, Biotechnol. Bioeng., 111(8):1638-47 (Aug. 2014).
Calvo et al., Genetic connection between fatty acid metabolism and sporulation in Aspergillus nidulans, J. Biol. Chem., 276(28):25766-74 (Jul. 2001).
Certik et al., Desaturase-defective fungal mutants: useful tools for the regulation and overproduction of polyunsaturated fatty acids, Trends in Biotechnology, vol. 16, No. 12, Dec. 1, 1998, pp. 500-505.
Deal et al., Histone variants and modifications in plant gene regulation, Curr. Opin. Plant Biol., 14(2):116-22 (Apr. 2011).
Demeke et al., Influence of DNA extraction methods, PCR inhibitors and quantification methods on real-time PCR assay of biotechnology-derived traits, Anal. Bioanal. Chem., 396(6):1977-90 (Mar. 2010).
Denic et al., A molecular caliper mechanism for determining very long-chain fatty acid length, Cell, 130(4):663-77 (Aug. 2007).
Fraser et al., Partial purification and photoaffinity labelling of sunflower acyl-CoA:lysophosphatidylcholine acyltransferase, Biochem. Soc. Trans., 28(6):715-8 (Dec. 2000).
Fukuda, Characterization of matrix attachment sites in the upstream region of a tobacco chitinase gene, Plant Mol. Biol., 39(5):1051-62 (Mar. 1999).
Giusto et al., Lipid metabolism in vertebrate retinal rod outer segments, Prog. Lipid Res., 39(4):315-91 (Jul. 2000).
Hamilton, A binary-BAC system for plant transformation with high-molecular-weight DNA, Gene, 200(1-2):107-16 (Oct. 1997).
Hattori et al., Experimentally determined sequence requirement of ACGT-containing abscisic acid response element, Plant Cell Physiol., 43(1):136-40 (Jan. 2002).
He et al, Agrobacterium-Mediated Transformation of Large DNA Fragments Using a BIBAC Vector System in Rice, Plant Molecular Biology Reporter, vol. 28, No. 4, Mar. 2, 2010, pp. 613-619.
Higo et al., Plant cis-acting regulatory DNA elements (PLACE) database: 1999, Nucleic Acids Res., 27(1):297-300 (Jan. 1999).
Hinnebusch, The scanning mechanism of eukaryotic translation initiation, Annu. Rev. Biochem., 83:779-812 (2014).
Horrocks et al., Health benefits of Docosahexaenoic acid (DHA), Pharmacol. Res., 40(3):211-25 (Sep. 1999).
Keller et al., Crystal structure of a bZIP/DNA complex at 2.2 A: determinants of DNA specific recognition, J. Mol. Biol., 254(4):657-67 (Dec. 1995).
Kim et al., Transcription factors that directly regulate the expression of CSLA9 encoding mannan synthase in *Arabidopsis thaliana*, Plant Mol. Biol., 84(4-5):577-87 (Mar. 2014).
Komori et al., Current status of binary vectors and superbinary vectors, Plant Physiol., 145(4):1155-60 (Dec. 2007).
Kong et al., Expression levels of domestic cDNA cassettes integrated in the nuclear genomes of various Chlamydomonas reinhardtii strains, J. Biosci. Bioeng., 117(5):613-6 (May 2014).
Kozak, Initiation of translation in prokaryotes and eukaryotes, Gene, 234(2):187-208 (Jul. 1999).
Lopez et al., Identification of novel motif patterns to decipher the promoter architecture of co-expressed genes in *Arabidopsis thaliana*, BMC Syst. Biol., 7 Suppl 3:S10 (Oct. 2013).
Lowenthal et al., Quantitative bottom-up proteomics depends on digestion conditions, Anal. Chem., 86(1):551-8 (Jan. 2014).
Machens et al., Identification of a novel type of WRKY transcription factor binding site in elicitor-responsive cis-sequences from *Arabidopsis thaliana*, Plant Mol. Biol., 84(4-5):371-85 (2014).
Makriyannis et al., Design and study of peptide-ligand affinity chromatography adsorbents: application to the case of trypsin purification from bovine pancreas, Biotechnol. Bioeng., 53(1):49-57 (Jan. 1997).
Mantle et al., Differentiation of Claviceps purpurea in axenic culture, J. Gen. Microbiol., 93(2):321-34 (Apr. 1976).
Meggendorfer et al., Functional nuclear topography of transcriptionally inducible extra-chromosomal transgene clusters, CHromosome Res., 18(4):401-17 (Jun. 2010).

(56) References Cited

OTHER PUBLICATIONS

Mendel, *Versuche über Pflanzenhybriden* Verhandlungen des naturforschenden Vereines in Brünn, Bd. IV für das Jahr, 1865 Abhandlungen:3-47 (1866).

Mey et al., The biotrophic, non-appressorium-forming grass pathogen Claviceps purpurea needs a Fus3/Pmk1 homologous mitogen-activated protein kinase for colonization of rye ovarian tissue, Mol. Plant Microbe Interact., 15(4):303-12 (Apr. 2002).

Muino et al., Structural determinants of DNA recognition by plant MADS-domain transcription factors, Nucleic Acids Res., 42(4):2138-46 (Feb. 2014).

Murashige et al., A Revised Medium for Rapid Growth and Bio Assays with Tobacco Tissue Cultures. Physiologia Plantarum 15, 3:473-497 (1962).

Nakagawa et al., Diversity of preferred nucleotide sequences around the translation initiation codon in eukaryote genomes, Nucleic Acids Res., 36(3):861-71 (Feb. 2008).

Nishikata et al., Database construction for PromoterCAD: synthetic promoter design for mammals and plants, ACS Synth. Biol., 3(3):192-6 (Mar. 2014).

Parker et al., Local DNA topography correlates with functional noncoding regions of the human genome, Science, 324(5925):389-92 (Apr. 2009).

Petrie et al., Metabolic engineering *Camelina sativa* with fish oil-like levels of DHA, PLoS One, 9(1):e85061 (Jan. 2014).

Potts et al., Inheritance of fatty acid composition in *Brassica juncea*, Proceedings of the 10th International Rapeseed Congress, Sep. 26, 1999.

Proc et al., A quantitative study of the effects of chaotropic agents, surfactants, and solvents on the digestion efficiency of human plasma proteins by trypsin, J> Proteome Res., 9(10):5422-37 (Oct. 2010).

Ramamoorthy et al., Length and sequence dependent accumulation of simple sequence repeats in vertebrates: potential role in genome organization and regulation, Gene, 551(2):167-75 (Nov. 2014).

Schwender et al., "Rubisco without the Calvin cycle improves the carbon efficiency of developing green seeds", Nature, 432:779-82 (2004).

Smith et al., Measurement of protein using bicinchoninic acid, Anal. Biochem., 150(1):76-85 (Oct. 1985).

Spector, Essentiality of fatty acids, Lipids, 34 Suppl: S1-3 (1999).

Stymne et al., Evidence for the reversibility of the acyl-CoA:lysophosphatidylcholine acyltransferase in microsomal preparations from developing safflower (*Carthamus tinctorius* L.) cotyledons and rat liver, Biochem. J., 233(2):305-14 (1984).

Sánchez-García et al., Differential temperature regulation of three sunflower microsomal oleate desaturase (FAD2) isoforms overexpressed in *Saccharomyces cerevisia*, Eur. J. Lipid Sci. Tech., 106:583-590 (2004).

Tudzynski et al., Biotechnology and genetics of ergot alkaloids, Appl. Microbiol. Biotechnol., 57(5-6):593-605 (Dec. 2001).

Tumaney et al., Synthesis of azidophospholipids and labeling of lysophosphatidylcholine acyltransferase from developing soybean cotyledons, Biochim. Biophys. Acta, 1439(1):47-56 (Jul. 1999).

Wachter et al., Synthetic CpG islands reveal DNA sequence determinants of chromatin structure, Elife, 3:e03397 (Sep. 2014).

Wijesundra, The influence of triacylglycerol structure on the oxidative stability of polyunsaturated oils, Lipid Technology, 20:199-202 (2008).

Yamashita et al., ATP-independent fatty acyl-coenzyme A synthesis from phospholipid: coenzyme A-dependent transacylation activity toward lysophosphatidic acid catalyzed by acyl-coenzyme A:lysophosphatidic acid acyltransferase, J. Biol. Chem., 276(29):26745-52 (Jul. 2001).

Eiamsa-ard et al., Two novel Physcomitrella patens fatty acid elongases (ELOs): identification and functional characterization, Appl. Microbiol. Biotechnol., 97:3485-3497 (2013).

Meyer et al., Novel fatty acid elongases and their use for the reconstitution of docosahexaenoic acid biosynthesis, Journal of Lipid Research, 45:1899-1909 (2004).

Shrestha et al., Int. J. Mol. Sci., Comparison of the substrate preferences of ω3 fatty acid desaturases for long chain polyunsaturated fatty acids, 20:3058 (2019).

Wang et al., ω3 fatty acid desaturases from microorganisms: structure, function, evolution, and biotechnological use, App. Microbiol., 97:10255-62 (2013).

Goffman, et al., "Genetic variation of tocopherol content in a germplasm collection of Brassica napus L.", Euphytica, vol. 125, May 2002, pp. 189-196.

\* cited by examiner

MATERIALS AND METHODS FOR INCREASING THE TOCOPHEROL CONTENT IN SEED OIL

This application is a National Stage application of International Application No. PCT/EP2015/076608, filed Nov. 13, 2015, which claims the benefit of U.S. Provisional Patent Application No. 62/079,622, filed Nov. 14, 2014 and U.S. Provisional Patent Application No. 62/234,373, filed Sep. 29, 2015, which are incorporated herein by reference in their entirety.

FIELD OF THE INVENTION

Incorporation by Reference of Material Submitted Electronically

The Sequence Listing, which is a part of the present disclosure, is submitted concurrently with the specification as a text file. The name of the text file containing the Sequence Listing is "150218 Seqlisting.txt", which was created on May 9, 2017 and is 1,303,552 bytes in size. The subject matter of the Sequence Listing is incorporated herein in its entirety by reference.

The present invention relates generally to the field of molecular biology and concerns increasing the tocopherol content of a plant relative to a control plant, comprising expressing in a plant at least one polynucleotide encoding a delta-12-desaturase, at least one polynucleotide encoding a delta-6-desaturase, at least one polynucleotide encoding a delta-6-elongase, and at least one polynucleotide encoding a delta-5-desaturase. The present invention also relates to methods for the manufacture of oil, fatty acid- or lipids-containing compositions, and to such oils and lipids as such.

Background of the Invention

Fatty acids are carboxylic acids with long-chain hydrocarbon side groups that play a fundamental role in many biological processes. Fatty acids are rarely found free in nature but, rather, occur in esterified form as the major component of lipids. As such, lipids/fatty acids are sources of energy (e.g., beta-oxidation). In addition, lipids/fatty acids are an integral part of cell membranes and, therefore, are indispensable for processing biological or biochemical information.

Very long chain polyunsaturated fatty acids (VLC-PUFAs) such as docosahexaenoic acid (DHA, 22:6(4,7,10,13,16,19)) are essential components of cell membranes of various tissues and organelles in mammals (e.g. nerve, retina, brain and immune cells). Clinical studies have shown that DHA is essential for the growth and development of the brain in infants, and for maintenance of normal brain function in adults (Martinetz, M. (1992) J. Pediatr. 120:S129 S138). DHA also has significant effects on photoreceptor function involved in the signal transduction process, rhodopsin activation, and rod and cone development (Giusto, N. M., et al. (2000) Prog. Lipid Res. 39:315-391). In addition, some positive effects of DHA were also found on diseases such as hypertension, arthritis, atherosclerosis, depression, thrombosis and cancers (Horrocks, L. A. and Yeo, Y. K. (1999) Pharmacol. Res. 40:211-215). Therefore, an appropriate dietary supply of DHA is important for human health. The human body is able to convert eicosapentaenoic acid (EPA, 20:5(5,8,11,14,17)) into DHA. EPA is normally found in marine food and is abundant in oily fish from the North Atlantic. In addition to serving as a precursor to DHA, EPA can also be converted into eicosanoids in the human body. The eicosanoids produced from EPA have anti-inflammatory and anti-platelet aggregating properties. A large number of beneficial health effects have been shown for DHA or mixtures of EPA and DHA.

Vitamin E (tocopherol) is a lipid soluble antioxidant that is important for preventing oxidative damage in both plants and animals and is known to have a beneficial effect in the prevention of cardiovascular disease. Vitamin E naturally occurs in vegetable oils, where it functions to prevent oxidative damage. Vegetable oils therefore represent a useful source of vitamin E in the human diet. Additionally, vitamin E extracted from vegetable oils is used as an additive in other food, health supplement, and cosmetic products.

Up to now it has not been possible to correlate vitamin E concentration with any n-3 VLC-PUFA (i.e., EPA or DHA) component of oil. Vitamin E occurs in plants as various forms of tocopherol, including alpha-, beta-, gamma-, and delta. A study containing 52 landraces and 15 breeding lines of *Brassica napus* revealed a significant positive correlation between alpha-tocopherol and 18:1+18:2, but no correlation between gamma-tocopherol and any fatty acid component (Li et al. (2013) J Agric Food Chem 61:34-40). Tocopherol concentrations have not been correlated with the degree of unsaturation in various *Brassica napus* seeds with genetically altered fatty acid composition (Abidi et al (1999) J Am Oil Chem Soc 76, 463-467, and Dolde et al (1999) J Am Oil Chem Soc 76, 349-355).

There is thus the need to provide a reliable source for plants, in particular seeds, comprising tocopherol in preferably high concentrations.

SUMMARY OF THE INVENTION

The invention is thus concerned with a method for increasing the tocopherol content of a plant relative to a control plant, comprising expressing in a plant at least one polynucleotide encoding a delta-12-desaturase, at least one polynucleotide encoding a delta-6-desaturase, at least one polynucleotide encoding a delta-6-elongase, and at least one polynucleotide encoding a delta-5-desaturase.

In an embodiment, the method further comprises expressing in the plant at least one polynucleotide encoding an omega-3-desaturase.

In an embodiment, the method further comprises expressing in the plant at least one polynucleotide encoding a delta-5-elongase.

In an embodiment, the method further comprises expressing in the plant at least one polynucleotide encoding a delta-4-desaturase. Preferably, two or more polynucleotides encoding a delta-4-desaturase are expressed. More preferably, at least one polynucleotide encoding a Coenzyme A dependent delta-4-desaturase and at least one polynucleotide encoding a phospholipid dependent delta-4-desaturase.

Preferably, at least two of the further polynucleotides are expressed. Further, the present invention contemplates the expression of all three further polynucleotides. Thus, the method may further comprise expressing at least one polynucleotide encoding a delta-5-elongase, at least one polynucleotide encoding a delta-4-desaturase (preferably at least one polynucleotide for a Coenzyme A dependent delta-4 desaturase and at least one for a phospholipid dependent delta-4 desaturase), and at least one polynucleotide encoding an omega-3 desaturase.

Moreover, the method of the present invention may further comprise expressing in the plant at least one polynucleotide encoding a delta-15-desaturase.

In an embodiment, at least one polynucleotide encoding a delta-6 elongase from *Physcomitrella patens*, at least one polynucleotide encoding a delta-12 desaturase from *Phythophthora sojae*, at least one polynucleotide encoding a delta-6 desaturase from *Ostreococcus tauri*, at least one polynucleotide encoding a delta-6 elongase from *Thalassiosira pseudonana*, at least one polynucleotide (preferably at least two polynucleotides) encoding a delta-5 desaturase from *Thraustochytrium* sp. (preferably from *Thraustochytrium* sp. ATCC21685), and optionally at least one polynucleotide (preferably, at least two polynucleotides) encoding a omega-3 desaturase from *Pythium irregulare*, at least one polynucleotide encoding a omega-3-desaturase from *Phythophthora infestans*, at least one polynucleotide encoding a delta-5 elongase from *Ostreococcus tauri*, and at least one polynucleotide encoding a delta-4 desaturase from *Thraustochytrium* sp., and at least one polynucleotide encoding a delta-4 desaturase from *Pavlova lutheri* are expressed. Preferably, at least two polynucleotides encoding a delta-5 desaturase from *Thraustochytrium* sp. (preferably from *Thraustochytrium* sp. ATCC21685) are expressed. Moreover, it is envisaged to express at least two polynucleotides encoding a omega-3 desaturase from *Pythium irregulare*. As set forth elsewhere herein, also variants of the aforementioned polynucleotides can be expressed.

In accordance with the method of the present invention, it is envisaged that at least one polynucleotide encoding a delta-12-desaturase, at least one polynucleotide encoding a delta-6-desaturase, at least two polynucleotides encoding a delta-6-elongase, at least two polynucleotides encoding a delta-5-desaturase, and optionally at least three polynucleotides encoding an omega-3-desaturase, and at least one polynucleotide encoding a delta-5-elongase, and at least two polynucleotides encoding a delta-4-desaturase are expressed. Preferably, at least one polynucleotide encoding a Coenzyme A dependent delta-4-desaturase and at least one polynucleotide encoding a phospholipid dependent delta-4-desaturase are expressed.

In an embodiment, the polynucleotides are expressed in the seeds of the plant.

In accordance with the present invention, the tocopherol content shall be preferably increased in the seeds of the plant as compared to the tocopherol content in seeds of a control plant, in particular the tocopherol content is increased in the seed oil of the plant as compared to the seed oil of a control plant.

Preferably, the polynucleotides encoding the elongases and desaturases referred to above are recombinant polynucleotides. They may be expressed in a plant by introducing them into the plant by recombinant means such as *Agrobacterium*-mediated transformation. Thus, the method may comprise the steps of introducing and expressing the above-referenced polynucleotides.

In one embodiment, the method may further comprise the step of selecting for plants having an increased tocopherol content (as compared to a control plant).

In accordance with the present invention, polynucleotides are referred to herein above present on one T-DNA or construct (and thus on the same T-DNA or construct). Said construct or T-DNA shall be is stably integrated in the genome of the plant. In an embodiment, the plant is homozygous for the T-DNA. In another embodiment, the plant is hemizygous for the T-DNA. If the plant is homozygous for one T-DNA at one locus, this is nevertheless considered as a single copy herein, i.e. as one copy. Double copy, as used herein, refers to a plant in which two T-DNAs have been inserted, at one or two loci, and in the hemizygous or homozygous state.

The present invention also relates to a construct or T-DNA comprising expression cassettes for the polynucleotides as set forth in the context of method of the present invention for increasing the tocopherol content.

Preferably, the construct or T-DNA shall comprise expression cassettes for at least one polynucleotide encoding a delta-12-desaturase, at least one polynucleotide encoding a delta-6-desaturase, at least one polynucleotide encoding a delta-6-elongase, and at least one polynucleotide encoding a delta-5-desaturase, and optionally for at least one of the further polynucleotides encoding the desaturases or elongases referred to above.

The present invention further concerns the use of the polynucleotides as set forth in the context of the present invention, or of a construct or T-DNA comprising expression cassettes for said polynucleotides for increasing the tocopherol content of a plant relative to control plants.

The present invention also relates to a plant comprising expression cassettes for the polynucleotides as referred to in the context of the method of the present invention for increasing the tocopherol content, or comprising the T-DNA or construct of the present invention.

The present invention also relates to a seed of the plant of the present invention. Said seed shall comprise expression cassettes for the polynucleotides as referred to in the context of the method of the present invention for increasing the tocopherol content, or comprising the T-DNA or construct of the present invention. In an embodiment, the seed shall comprise an of oil the present invention. The oil is described herein below.

Preferably, the method for increasing the tocopherol content comprises the further step of obtaining an oil from the plant, in particular from the seeds of the plant. Said oil shall have an increased tocopherol content as specified elsewhere herein. In addition, the oil shall have an increased content of VLC-PUFAs. In accordance with the present invention, the oil shall be obtained from the plant under conditions which maintain the tocopherol content. Such methods are well known in the art.

The invention also provides methods of producing an oil, wherein the oil has a high content of tocopherol. In addition, the oil may have a high VLC-PUFA content, in particular a high content of EPA and/or DHA. In particularly preferred aspects these methods are for producing a corresponding plant oil. Thus, the invention also provides methods of producing an oil.

The invention also provides methods for creating a plant, such that the plant or progeny thereof can be used as a source of an oil having a high content of tocopherol. Preferably, the oil further has a high VLC-PUFA content, in particular a high content of EPA and/or DHA. Thus, the invention beneficially also provides methods for the production of plants having a heritable phenotype of high tocopherol content in seed oil. Further, the plants may have a hight VLC-PUFA content in one or more of their tissues or components, preferably a high content of EPA and/or DHA in seed oil.

DETAILED DESCRIPTION OF THE INVENTION

Various aspects of the invention are hereinafter described in more detail. The definitions and explanations given in the previous section apply accordingly. It is to be understood that the detailed description is not intended to limit the scope of the claims.

Tocopherols are well known in the art. The term "content of tocopherol" preferably refers to the total tocopherol content, i.e. to the sum of the amounts of the tocopherols present in the plant, plant part (preferably in the seed) or oil (in particular in seed oil) thereof. In particular, the term refers to the sum of the amounts of alpha-tocopherol, beta-tocopherol, gamma-tocopherol, and delta-tocopherol. However, it is also envisaged that term refers to the amount of alpha-tocopherol, the amount of beta-tocopherol, and to the amount of gamma-ocopherol, or the amount of delta-tocopherol. In a preferred embodiment, the term refers to the amount of gamma-tocopherol. In another preferred embodiment, the term to the amount of delta-tocopherol. Also preferably, the term refers to the amount of total tocopherol, gamma-tocopherol and/or delta-tocopherol.

Thus, "tocopherol" in the context of the present invention, preferably, refers to total tocopherol, alpha-tocopherol, beta-tocopherol, gamma-tocopherol, and/or delta-tocopherol. In particular, the term refers to total tocopherol, gamma-tocopherol, or delta-tocopherol The term "amount" or "content" preferably refers to the absolute amount or the concentration (preferably, in the plant, more preferably in the seed and most preferably in the seed oil). In an embodiment, the content of tocopherol is increased in the seed oil of a plant as compared to the seed oil of a control plant.

Increasing the content of tocopherols refers to the increase of the content of tocopherols in a plant, or a part, tissue or organ thereof, preferably in the seed, in particular in the oil compared to a control plant by at least 1%, at least 5%, at least 10%, at least 12% or at least 15%.

An "increased content" or "high content" of tocopherol as referred to herein preferably refers to a total content of tocopherol in seed oil of more than 97 mg/100 g seed oil, in particular of more than 100 mg/100 g seed oil, a content of alpha tocopherol in seed oil of more than 31 mg/100 g seed oil, in particular of more than 33 mg/100 g seed oil, a content of beta tocopherol in seed oil of more than 0.6 mg/100 g seed oil, a content of gamma tocopherol in seed oil of more than 65 mg/100 g seed oil, in particular of more than 70 mg/100 g seed oil, or a content of delta tocopherol in seed oil of more than 1.4 mg/100 g seed oil, in particular of more than 1.5 mg/100 g seed oil.

Also, an "increased content" or "high content" of tocopherol as referred to herein preferably refers to a total seed content of tocopherol of more than 35 mg/100 g seed, in particular of more than 39 mg/100 g seed, a seed content of alpha tocopherol in seed of more than 12 mg/100 g seed, in particular of more than 13 mg/100 g seed, a seed content of beta tocopherol in seed of more than 0.22 mg/100 g seed, a seed content of gamma tocopherol in seed of more than 25 mg/100 g seed, in particular of more than 26 mg/100 g seed, or a seed content of delta tocopherol in seed of more than 0.45 mg/100 g seed, in particular of more than 0.48 mg/100 g seed.

The seeds, in particular the oil, may further comprise a high VLC-PUFA (very long chain polyunsaturated fatty acid) content.

The choice of suitable control plants is a routine part of an experimental setup and may include corresponding wild type plants or corresponding plants without the polynucleotides as encoding desaturases and elongase as referred to herein. The control plant is typically of the same plant species or even of the same variety as the plant to be assessed. The control plant may also be a nullizygote of the plant to be assessed. Nullizygotes (or null control plants) are individuals missing the transgene by segregation. Further, control plants are grown under the same or essentially the same growing conditions to the growing conditions of the plants of the invention, i.e. in the vicinity of, and simultaneously with, the plants of the invention. A "control plant" as used herein preferably refers not only to whole plants, but also to plant parts, including seeds and seed parts. The control could also be the oil from a control plant.

Preferably, the control plant is an isogenic control plant (thus, the control oil e.g. shall be from an isogenic control plant).

The term "polyunsaturated fatty acids (PUFA)" as used herein refers to fatty acids comprising at least two, preferably, three, four, five or six, double bonds. Moreover, it is to be understood that such fatty acids comprise, preferably from 18 to 24 carbon atoms in the fatty acid chain. More preferably, the term relates to long chain PUFA (VLC-PUFA) having from 20 to 24 carbon atoms in the fatty acid chain. Particularly, polyunsaturated fatty acids in the sense of the present invention are DHGLA 20:3 (8,11,14), ARA 20:4 (5,8,11,14), ETA 20:4 (8,11,14,17), EPA 20:5 (5,8,11,14,17), DPA 22:5 (4,7,10,13,16), DPA n-3 (7,10,13,16,19) DHA 22:6 (4,7,10,13,16,19), more preferably, eicosapentaenoic acid (EPA) 20:5 (5,8,11,14,17), and docosahexaenoic acid (DHA) 22:6 (4,7,10,13,16,19). Thus, it will be understood that most preferably, the methods provided by the present invention pertain to the manufacture of EPA and/or DHA and/or tocopherol. Moreover, also encompassed are the intermediates of VLC-PUFA which occur during synthesis. Such intermediates are, preferably, formed from substrates by the desaturase, keto-acyl-CoA-synthase, keto-acyl-CoA-reductase, dehydratase and enoyl-CoA-reductase activity of the polypeptide of the present invention. Preferably, substrates encompass LA 18:2 (9,12), GLA 18:3 (6,9,12), DHGLA 20:3 (8,11,14), ARA 20:4 (5,8,11,14), eicosadienoic acid 20:2 (11,14), eicosatetraenoic acid 20:4 (8,11,14,17), eicosapentaenoic acid 20:5 (5,8,11,14,17). Systematic names of fatty acids including polyunsaturated fatty acids, their corresponding trivial names and shorthand notations used according to the present invention are given in the following table:

| Systematic name | Trivial Name | Short hand 1 | Short hand 2 |
|---|---|---|---|
| Hexadecanoic acid | Palmitic acid | 16:0 | |
| (Z)-7-Hexadecenoic acid | | 16:1n-9 | |
| (Z,Z,Z)-7,10,13-Hexadecatrienoic acid | | 16:3n-3 | |
| Octadecanoic acid | Stearic acid | 18:0 | |
| (Z)-9-Octadecenoic acid | Oleic acid | 18:1n-9 | OA |
| (Z,Z)-9,12-Octadecadienoic acid | Linoleic acid | 18:2n-6 | LA |
| (Z,Z)-6,9-Octadecadienoic acid | | 18:2n-9 | |
| (Z,Z,Z)-9,12,15-Octadecatrienoic acid | alpha-Linolenic acid | 18:3n-3 | ALA |

-continued

| Systematic name | Trivial Name | Short hand 1 | Short hand 2 |
|---|---|---|---|
| (Z,Z,Z)-6,9,12-Octadecatrienoic acid | gamma Linolenic acid | 18:3n-6 | GLA |
| (Z,Z,Z,Z)-6,9,12,15-Octadecatetraenoic acid | Stearidonic acid | 18:4n-3 | SDA |
| Eicosanoic acid | Arachidic acid | 20:0 | |
| (Z)-11-Eicosenoic acid | Gondoic acid | 20:1n-9 | |
| (Z,Z)-11,14-Eicosadienoic acid | | 20:2n-6 | |
| (Z,Z,Z)-11,14,17-Eicosatrienoic acid | | 20:3n-3 | |
| (Z,Z,Z)-8,11,14-Eicosatrienoic acid | Dihomo-gamma-linolenic acid | 20:3n-6 | DHGLA |
| (Z,Z,Z)-5,8,11-Eicosatrienoic acid | Mead acid | 20:3n-9 | |
| (Z,Z,Z,Z)-8,11,14,17-Eicosatetraenoic acid | | 20:4n-3 | ETA |
| (Z,Z,Z,Z)-5,8,11,14-Eicosatetraenoic acid | Arachidonic acid | 20:4n-6 | ARA |
| (Z,Z,Z,Z,Z)-5,8,11,14,17-Eicosapentaenoic acid | Timnodonic acid | 20:5n-3 | EPA |
| Docosanoic acid | Behenic acid | 22:0 | |
| (Z)-13-Docosenoic acid | Erucic acid | 22:1n-9 | |
| (Z,Z,Z,Z)-7,10,13,16-Docosatetraenoic acid | Adrenic acid | 22:4n-6 | DTA |
| (Z,Z,Z,Z,Z)-7,10,13,16,19-Docosapentaenoic acid | Clupanodonic acid | 22:5n-3 | DPAn-3 |
| (Z,Z,Z,Z,Z)-4,7,10,13,16-Docosapentaenoic acid | Osbond acid | 22:5n-6 | DPAn-6 |
| (Z,Z,Z,Z,Z,Z)-4,7,10,13,16,19-Docosahexaenoic acid | | 226n-3 | DHA |

The term "cultivating" as used herein refers to maintaining and growing the transgenic plant under culture conditions which allow the cells to produce tocopherol in a plant, a seed comprising an increased tocopherol content or an oil comprising and increased tocopherol content (as compared to a control). This implies that the polynucleotides as referred to herein in connection with the method of the present invention are present in the plant. Suitable culture conditions for cultivating the host cell are described in more detail below.

Preferably, the polynucleotides encoding the enzymes as referred to herein are stably integrated into the genome of the plant. More preferably, the polynucleotides are present on one T-DNA or construct which is stably integrated into the genome of the plant. Thus, they are preferably present on a single, i.e. the same T-DNA (or construct). The same applies to the expression cassettes as referred to herein. Accordingly, the polynucleotides or expression cassettes are preferably comprised by the same T-DNA.

It is to be understood that more than one copy of the T-DNA (or construct) may be present in the plant (e.g. in plants which are homozygous for the T-DNA (or construct), or in plants in which Agrobacterium mediated transformation resulted in more than one integration event.

The term "obtaining" as used herein encompasses the provision of the cell culture including the host cells and the culture medium or the plant or plant part, particularly the seed, of the current invention, as well as the provision of purified or partially purified preparations thereof comprising the tococpherol The plant, plant part or purified or partially purified preparations may further comprise the polyunsaturated fatty acid, preferably, ARA, EPA, DHA, in free or in CoA bound form, as membrane phospholipids or as triacylglyceride esters. More preferably, the PUFA and VLC-PUFA are to be obtained as triglyceride esters, e.g., in the form of an oil. More details on purification techniques can be found elsewhere herein below.

The term "polynucleotide" according to the present invention refers to a desoxyribonucleic acid or ribonucleic acid. Unless stated otherwise, "polynucleotide" herein refers to a single strand of a DNA polynucleotide or to a double stranded DNA polynucleotide. The length of a polynucleotide is designated according to the invention by the specification of a number of basebairs ("bp") or nucleotides ("nt"). According to the invention, both specifications are used interchangeably, regardless whether or not the respective nucleic acid is a single or double stranded nucleic acid. Also, as polynucleotides are defined by their respective nucleotide sequence, the terms nucleotide/polynucleotide and nucleotide sequence/polynucleotide sequence are used interchangeably, thus that a reference to a nucleic acid sequence also is meant to define a nucleic acid comprising or consisting of a nucleic acid stretch, the sequence of which is identical to the nucleic acid sequence.

In particular, the term "polynucleotide" as used in accordance with the present invention as far as it relates to a desaturase or elongase gene relates to a polynucleotide comprising a nucleic acid sequence which encodes a polypeptide having desaturase or elongase activity. Preferred polynucleotides encoding polypeptides having desaturase or elongase activity as shown in Table 2 in the Examples section (the SEQ ID NOs of the nucleic acid sequences and the polypeptide sequences are given in the last two columns).

Preferably, the polypeptides encoded by the polynucleotides of the present invention having desaturase or elongase activity upon combined expression in a plant shall be capable of increasing the content, and thus the amount of tocopherol in a plant in particular, in seeds, seed oils or an entire plant or parts thereof. Whether an increase is statistically significant can be determined by statistical tests well known in the art including, e.g., Student's t-test with a confidentiality level of at least 90%, preferably of at least 95% and even more preferably of at least 98%. More preferably, the increase is an increase of the amount of tocopherol of at least 1%, at least 5%, at least 10%, at least 12% or at least 15% (preferably, by weight) compared to a control, in particular to the content in seeds, seed oil, crude oil, or refined oil from a control.

In addition, the polypeptides having desaturase or elongase activity upon combined expression in a plant shall be capable of increasing the amount of PUFA and, in particular, VLC-PUFA in, e.g., seed oils or an entire plant or parts thereof. More preferably, the increase is an increase of the amount of triglycerides containing VLC-PUFA of at least 5%, at least 10%, at least 15%, at least 20% or at least 30% (preferably by weight) compared to wild-type control, in seeds, seed oil, crude oil, or refined oil from a wildtype control.

Thus, the present invention allows for producing an oil having not only an increased tocopherol content as compared to tocopherol content of oil of control plants but also an increased content of PUFA, in particular, of VLC-PUFA.

Preferably, the VLC-PUFA referred to before is a polyunsaturated fatty acid having a C20, C22 or C24 fatty acid body, more preferably EPA and/or DHA. Lipid analysis of oil samples are shown in the accompanying Examples.

The fatty acid esters with polyunsaturated C20- and/or C22-fatty acid molecules can be isolated in the form of an oil or lipid, for example, in the form of compounds such as sphingolipids, phosphoglycerides, lipids, glycolipids such as glycosphingolipids, phos-pholipids such as phosphatidylethanolamine, phosphatidylcholine, phosphatidylserine, phosphatidylglycerol, phosphatidylinositol or diphosphatidylglycerol, monoacylglycerides, diacylglycerides, triacylglycerides or other fatty acid esters such as the acetylcoenzyme A esters which comprise the polyunsaturated fatty acids with at least two, three, four, five or six, preferably five or six, double bonds, from the organisms which were used for the preparation of the fatty acid esters. Preferably, they are isolated in the form of their diacylglycerides, triacylglycerides and/or in the form of phosphatidylcholine, especially preferably in the form of the triacylglycerides. In addition to these esters, the polyunsaturated fatty acids are also present in the non-human transgenic organisms or host cells, preferably in the plants, as free fatty acids or bound in other compounds.

The fatty acids are, preferably, produced in bound form. It is possible, with the aid of the polynucleotides and polypeptides of the present invention, for these unsaturated fatty acids to be positioned at the sn1, sn2 and/or sn3 position of the triglycerides which are, preferably, to be produced.

The desaturares and elongases referred to herein are well known in the art.

The term "desaturase" encompasses all enzymatic activities and enzymes catalyzing the desaturation of fatty acids with different lengths and numbers of unsaturated carbon atom double bonds. Specifically this includes delta 4 (d4)-desaturase, preferably catalyzing the dehydrogenation of the 4th and 5th carbon atom; Delta 5 (d5)-desaturase catalyzing the dehydrogenation of the 5th and 6th carbon atom; Delta 6 (d6)-desaturase catalyzing the dehydrogenation of the 6th and 7th carbon atom; Delta 15 (d15)-desaturase catalyzing the dehydrogenation of the 15th and 16th carbon atom. An omega 3 (o3) desaturase preferably catalyzes the dehydrogenation of the n-3 and n-2 carbon atom.

The terms "elongase" encompasses all enzymatic activities and enzymes catalyzing the elongation of fatty acids with different lengths and numbers of unsaturated carbon atom double bonds. Preferably, the term "elongase" as used herein refers to the activity of an elongase, introducing two carbon molecules into the carbon chain of a fatty acid, preferably in the positions 1, 5, 6, 9, 12 and/or 15 of fatty acids.

In a preferred embodiment, the term "elongase" shall to the activity of an elongase, introducing two carbon molecules to the carboxyl ends (i.e. position 1) of both saturated and unsaturated fatty acids.

In the studies underlying this invention, enzymes with superior desaturase and elongase catalytic activities for the increasing the content of tocopherol has been provided. Table 2 in the Examples section lists preferred polynucleotides encoding for preferred desaturases or elongase to be used in the present invention. Thus, polynucleotides desaturases or elongases that can be used in the context of the present invention are shown in table 2. As set forth elsewhere herein, also variants of the said polynucleotides can be used.

Polynucleotides encoding polypeptides which exhibit delta-6-elongase activity have been described in WO2001/059128, WO2004/087902 and WO2005/012316, said documents, describing this enzyme from *Physcomitrella patens*, are incorporated herein in their entirety.

Polynucleotides encoding polypeptides which exhibit delta-5-desaturase activity have been described in WO2002026946 and WO2003/093482, said documents, describing this enzyme from *Thraustochytrium* sp., are incorporated herein in their entirety.

Polynucleotides encoding polypeptides which exhibit delta-6-desaturase activity have been described in WO2005/012316, WO2005/083093, WO2006/008099 and WO2006/069710, said documents, describing this enzyme from *Ostreococcus tauri*, are incorporated herein in their entirety.

In an embodiment, the delta-6-desaturase is a CoA (Coenzyme A)-dependent delta-6-desaturase.

Polynucleotides encoding polypeptides which exhibit delta-6-elongase activity have been described in WO2005/012316, WO2005/007845 and WO2006/069710, said documents, describing this enzyme from *Thalassiosira pseudonana*, are incorporated herein in their entirety.

Polynucleotides encoding polypeptides which exhibit delta-12-desaturase activity have been described for example in WO2006100241, said documents, describing this enzyme from *Phytophthora sojae*, are incorporated herein in their entirety.

Polynucleotides encoding polypeptides which exhibit delta-4-desaturase activity have been described for example in WO2004/090123, said documents, describing this enzyme from *Euglena gracilis*, are incorporated herein in their entirety.

Polynucleotides encoding polypeptides which exhibit delta-5-elongase activity have been described for example in WO2005/012316 and WO2007/096387, said documents, describing this enzyme from *Ostreococcus tauri*, are incorporated herein in their entirety.

Polynucleotides encoding polypeptides which exhibit omega 3-desaturase activity have been described for example in WO2008/022963, said documents, describing this enzyme from *Pythium irregulare*, are incorporated herein in their entirety.

Polynucleotides encoding polypeptides which exhibit omega 3-desaturase activity have been described for example in WO2005012316 and WO2005083053, said documents, describing this enzyme from *Phytophthora infestans*, are incorporated herein in their entirety.

Polynucleotides encoding polypeptides which exhibit delta-4-desaturase activity have been described for example in WO2002026946, said documents, describing this enzyme from *Thraustochytrium* sp., are incorporated herein in their entirety.

Polynucleotides coding for a delta-4 desaturase from *Pavlova lutheri* are described in WO2003078639 and WO2005007845. These documents are incorporated herein in their entirety, particularly insofar as the documents relate to the delta-4 desaturase "PlDES 1" and FIGS. 3a-3d of WO2003078639 and FIGS. 3a, 3b of WO2005007845, respectively.

Polynucleotides encoding polypeptides which exhibit delta-15-desaturase activity have been described for example in WO2010/066703, said documents, describing this enzyme from *Cochliobolus heterostrophus* C5, are incorporated herein in their entirety.

The polynucleotides encoding the aforementioned polypeptides are herein also referred to as "target genes" or "nucleic acid of interest". The polynucleotides are well known in the art. The sequences of said polynucleotides can be found in the sequence of the T-DNA disclosed in the Examples section (see e.g. the sequence of VC-LTM593-1qcz which has a sequence as shown in SEQ ID NO: 3, see also Table 1). The polynucleotide and polypeptide sequences are also given in Table 2 in the Examples section.

Sequences of preferred polynucleotides for the desaturases and elongases referred to herein in connection with the present invention are indicated below. As set forth elsewhere herein, also variants of the polynucleotides can be used. The polynucleotides encoding for desaturases and elogases to be used in accordance with the present invention can be derived from certain organisms. Preferably, a polynucleotide derived from an organism (e.g from *Physcomitrella patens*) is codon-optimized. In particular, the polynucleotide shall be codon-optimized for expression in a plant.

The term "codon-optimized" is well understood by the skilled person. Preferably, a codon optimized polynucleotide is a polynucleotide which is modified by comparison with the nucleic acid sequence in the organism from which the sequence originates in that it is adapted to the codon usage in one or more plant species. Typically, the polynucleotide, in particular the coding region, is adapted for expression in a given organism (in particular in a plant) by replacing at least one, or more than one of codons with one or more codons that are more frequently used in the genes of that organism (in particular of the plant). In accordance with the present invention, a codon optimized variant of a particular polynucleotide "from an organism" (or "derived from an organism") preferably shall be considered to be a polynucleotide derived from said organism. Preferably, a codon-optimized polynucleotide shall encode for the same polypeptide having the same sequence as the polypeptide encoded by the non codon-optimized polynucleotide (i.e. the wild-type sequence). In the studies underlying the present invention, codon optimized polynucleotides were used (for the desaturases). The codon optimized polynucleotides are comprised by the T-DNA of the vector having a sequence as shown in SEQ ID NO: 3 (see table 1).

The sequences of preferred polynucleotides for the desaturases and elongases and the sequences corresponding polypeptides referred to herein in connection with the present invention are described herein below. Of course variants of polynucleotides and polynucleotides can be used in connection with the present invention (in particular in connection with the methods, T-DNAs, constructs, plants, seeds, etc.).

Preferably, a delta-6-elongase to be used in accordance with the present invention is derived from *Physcomitrella patens*. A preferred sequence of said delta-6-elongase is shown in SEQ ID NO:258. Preferably, said delta-6-elongase is encoded by a polynucleotide derived from *Physcomitrella patens*, in particular, said delta-6-elongase is encoded by a codon-optimized variant thereof. Preferably, the polynucleotide encoding the delta-6-elongase derived from *Physcomitrella patens* is a polynucleotide having a sequence as shown in nucleotides 1267 to 2139 of SEQ ID NO: 3. The sequence of this polynucleotide is also shown in SEQ ID No: 257.

Preferably, a delta-5-desaturase to be used in accordance with the present invention is derived from *Thraustochytrium* sp. *Thraustochytrium* sp. in the context of the present invention preferably means *Thraustochytrium* sp. ATCC21685. A preferred sequence of said delta-5-desaturase is shown in SEQ ID NO:260. Preferably, said delta-5-desaturase is encoded by a polynucleotide derived from *Thraustochytrium* sp.; in particular, said delta-5-desaturase is encoded by a codon-optimized variant of said polynucleotide. Preferably, the polynucleotide encoding the delta-5-desaturase derived from *Thraustochytrium* sp. is a polynucleotide having a sequence as shown in nucleotides 3892 to 5211 of SEQ ID NO: 3. The sequence of this polynucleotide is also shown in SEQ ID No: 259. In accordance with the present invention, it is envisaged to express two or more polynucleotides (i.e. two or more copies of a polynucleotide) encoding a delta-5-desaturase derived from *Thraustochytrium* sp. (preferably two polynucleotides). Thus, the T-DNA, construct, plant, seed etc. of the present invention shall comprise two (or more) copies of a polynucleotide encoding a delta-5-desaturase derived from *Thraustochytrium* sp.

Preferably, a delta-6-desaturase to be used in accordance with the present invention is derived from *Ostreococcus tauri*. A preferred sequence of said delta-6-desaturase is shown in SEQ ID NO:262. Preferably, said delta-6-desaturase is encoded by a polynucleotide derived from *Ostreococcus tauri*; in particular, said delta-6-desaturase is encoded by a codon-optimized variant of said polynucleotide. Preferably, the polynucleotide encoding the delta-6-desaturase derived from *Ostreococcus tauri* is a polynucleotide having a sequence as shown in nucleotides 7802 to 9172 of SEQ ID NO: 3. The sequence of this polynucleotide is also shown in SEQ ID No: 261.

Preferably, a delta-6-elongase to be used in accordance with the present invention is derived from *Thalassiosira pseudonana*. A preferred sequence of said delta-6-elongase is shown in SEQ ID NO:264. Preferably, said delta-6-elongase is encoded by a polynucleotide derived from *Thalassiosira pseudonana*; in particular, said delta-6-elongase is encoded by a codon-optimized variant of said polynucleotide. Preferably, the polynucleotide encoding the delta-6-elongase derived from *Thalassiosira pseudonana* is a polynucleotide having a sequence as shown in nucleotides 12099 to 12917 of SEQ ID NO: 3. The sequence of this polynucleotide is also shown in SEQ ID No: 263. (Thus, the polynucleotide encoding the delta-6-elongase derived from *Thalassiosira pseudonana* preferably has a sequence as shown in SEQ ID NO: 263)

Preferably, a delta-12-elongase to be used in accordance with the present invention is derived from *Phytophthora sojae*. A preferred sequence of said delta-12-elongase is shown in SEQ ID NO:266. Preferably, said delta-12-elongase is encoded by a polynucleotide derived from *Phytophthora sojae*; in particular, said delta-12-elongase is encoded by a codon-optimized variant of said polynucleotide. Preferably, the polynucleotide encoding the delta-12-elongase derived from *Phytophthora sojae* is a polynucleotide having a sequence as shown in nucleotides 14589 to 15785 of SEQ ID NO: 3. The sequence of this polynucleotide is also shown in SEQ ID No: 265.

Preferably, a delta-5-elongase to be used in accordance with the present invention is derived from *Ostreococcus tauri*. A preferred sequence of said delta-5-elongase is shown in SEQ ID NO:276. Preferably, said delta-5-elongase is encoded by a polynucleotide derived from *Ostreococcus tauri*; in particular, said delta-5-elongase is encoded by a codon-optimized variant of said polynucleotide. Preferably, the polynucleotide encoding the delta-5-elongase derived from *Ostreococcus tauri* is a polynucleotide having a sequence as shown in nucleotides 38388 to 39290 of SEQ ID NO: 3. The sequence of this polynucleotide is also shown in SEQ ID No: 275.

Preferably, an omega 3-desaturase to be used in accordance with the present invention is derived from *Pythium irregulare*. A preferred sequence of said omega 3-desaturase is shown in SEQ ID NO:268. Preferably, said omega 3-desaturase is encoded by a polynucleotide derived from *Pythium irregulare*; in particular, said omega 3-desaturase is encoded by a codon-optimized variant of said polynucleotide. Preferably, the polynucleotide encoding the omega 3-desaturase derived from *Pythium irregulare* is a polynucleotide having a sequence as shown in nucleotides 17690 to 18781 of SEQ ID NO: 3. The sequence of this polynucleotide is also shown in SEQ ID No: 267. In accordance with the present invention, it is envisaged to express two or more polynucleotides (i.e. two or more copies of a polynucleotide) encoding a omega 3-desaturase derived from *Pythium irregulare* (preferably two polynucleotides). Thus, the T-DNA, construct, plant, seed etc. of the present invention shall comprise two (or more) copies of a polynucleotide encoding a omega 3-desaturase derived from *Pythium irregulare*

Preferably, an omega 3-desaturase to be used in accordance with the present invention is derived from *Phytophthora infestans*. A preferred sequence of said omega 3-desaturase is shown in SEQ ID NO:270. Preferably, said omega 3-desaturase is encoded by a polynucleotide derived from *Phytophthora infestans*; in particular, said omega 3-desaturase is encoded by a codon-optimized variant of said polynucleotide. Preferably, the polynucleotide encoding the omega 3-desaturase derived from *Phytophthora infestans* is a polynucleotide having a sequence as shown in nucleotides 20441 to 21526 of SEQ ID NO: 3. The sequence of this polynucleotide is also shown in SEQ ID No: 269.

In accordance with the method of the present invention, it is in particular envisaged to express two or more non-identical polynucleotides encoding, preferably non-identical omega 3-desaturases in the plant. Preferably, at least one polynucleotide encoding an omega 3-desaturase from *Phytophthora infestans* and at least one polynucleotide (in particular two polynucleotides, i.e. two copies of a polynucleotide) encoding an omega 3-desaturase from *Pythium irregulare* are expressed.

Preferably, a delta-4-desaturase to be used in accordance with the present invention is derived from *Thraustochytrium* sp. A preferred sequence of said delta-4-desaturase is shown in SEQ ID NO:272. Preferably, said delta-4-desaturase is encoded by a polynucleotide derived from *Thraustochytrium* sp.; in particular, said delta-4-desaturase is encoded by a codon-optimized variant of said polynucleotide. Preferably, the polynucleotide encoding the delta-4-desaturase derived from *Thraustochytrium* sp. is a polynucleotide having a sequence as shown in nucleotides 26384 to 27943 of SEQ ID NO: 3. The sequence of this polynucleotide is also shown in SEQ ID No: 271.

Preferably, a delta-4-desaturase to be used in accordance with the present invention is derived from *Pavlova lutheri*. A preferred sequence of said delta-4-desaturase is shown in SEQ ID NO:274. Preferably, said delta-4-desaturase is encoded by a polynucleotide derived from *Pavlova lutheri*; in particular, said delta-4-desaturase is encoded by a codon-optimized variant of said polynucleotide. Preferably, the polynucleotide encoding the delta-4-desaturase derived from *Pavlova lutheri* is a polynucleotide having a sequence as shown in nucleotides 34360 to 35697 of SEQ ID NO: 3. The sequence of this polynucleotide is also shown in SEQ ID No: 273.

In accordance with the method of the present invention, it is further envisaged to express two non-identical polynucleotides encoding, preferably non-identical delta-4-desaturases in the plant. Preferably, at least one polynucleotide encoding a delta-4-desaturase from *Thraustochytrium* sp. and at least one polynucleotide (in particular two polynucleotides) encoding a delta-4-desaturase from *Pavlova lutheri* are expressed.

Preferably, a delta-15-desaturase to be used in accordance with the present invention is derived from *Cochliobolus heterostrophus*. Preferably, said delta-15-desaturase is encoded by a polynucleotide derived from *Cochliobolus heterostrophus*; in particular, said delta-15-desaturase is encoded by a codon-optimized variant of said polynucleotide. Preferably, the polynucleotide encoding the delta-15-desaturase derived from *Cochliobolus heterostrophus* is a polynucleotide having a sequence as shown in nucleotides 2151 to 3654 of SEQ ID NO: 9.

As set forth above, the polynucleotide encoding a delta-6-elongase can be derived from *Physcomitrella patens*. Moreover, the polynucleotide encoding a delta-6-elongase can be derived from *Thalassiosira pseudonana*. In particular, it is envisaged in the context of the method of the present invention to express at least one polynucleotide encoding a delta-6-elongase from *Physcomitrella patens* and at least one polynucleotide encoding a delta-6-elongase from *Thalassiosira pseudonana* in the plant.

A polynucleotide encoding a polypeptide having a desaturase or elongase activity as specified above is obtainable or obtained in accordance with the present invention for example from an organism of genus *Ostreococcus*, *Thraustochytrium*, *Euglena*, *Thalassiosira*, *Phytophthora*, *Pythium*, *Cochliobolus*, *Physcomitrella*. However, orthologs, paralogs or other homologs may be identified from other species. Preferably, they are obtained from plants such as algae, for example *Isochrysis*, *Mantoniella*, *Crypthecodinium*, algae/diatoms such as *Phaeodactylum*, mosses such as *Ceratodon*, or higher plants such as the Primulaceae such as Aleuritia, *Calendula stellata*, *Osteospermum spinescens* or *Osteospermum hyoseroides*, microorganisms such as fungi, such as *Aspergillus*, *Entomophthora*, *Mucor* or *Mortierella*, bacteria such as *Shewanella*, yeasts or animals. Preferred animals are nematodes such as *Caenorhabditis*, insects or vertebrates.

Among the vertebrates, the nucleic acid molecules may, preferably, be derived from Euteleostomi, Actinopterygii; Neopterygii; Teleostei; Euteleostei, Protacanthopterygii, Salmoniformes; Salmonidae or Oncorhynchus, more preferably, from the order of the Salmoniformes, most preferably, the family of the Salmonidae, such as the genus Salmo, for example from the genera and species Oncorhynchus mykiss, Trutta trutta or Salmo trutta fario. Moreover, the nucleic acid molecules may be obtained from the diatoms such as the genera *Thalassiosira* or *Phaeodactylum*.

Thus, the term "polynucleotide" as used in accordance with the present invention further encompasses variants or derivatives of the aforementioned specific polynucleotides representing orthologs, paralogs or other homologs of the polynucleotide of the present invention. Moreover, variants or derivatives of the polynucleotide of the present invention also include artificially generated muteins. Said muteins include, e.g., enzymes which are generated by mutagenesis techniques and which exhibit improved or altered substrate specificity, or codon optimized polynucleotides.

Nucleic acid variants or derivatives according to the invention are polynucleotides which differ from a given reference polynucleotide by at least one nucleotide substitution, addition and/or deletion. If the reference polynucleotide codes for a protein, the function of this protein is conserved in the variant or derivative polynucleotide, such that a variant nucleic acid sequence shall still encode a polypeptide having a desaturase or elongase activity as specified above. Variants or derivatives also encompass polynucleotides comprising a nucleic acid sequence which is capable of hybridizing to the aforementioned specific nucleic acid sequences, preferably, under stringent hybridization conditions. These stringent conditions are known to the skilled in the art and can be found in Current Protocols in Molecular Biology, John Wiley & Sons, N.Y. (1989), 6.3.1-6.3.6. A preferred example for stringent hybridization conditions are hybridization conditions in 6× sodium chloride/sodium citrate (=SSC) at approximately 45° C., followed by one or more wash steps in 0.2×SSC, 0.1% SDS at 50 to 65° C. (in particular at 65° C.). The skilled worker knows that these hybridization conditions differ depending on the type of nucleic acid and, for example when organic solvents are present, with regard to the temperature and concentration of the buffer. For example, under "standard hybridization conditions" the temperature ranges depending on the type of nucleic acid, between 42° C. and 58° C. in aqueous buffer, with a concentration of 0.1 to 5×SSC (pH 7.2). If organic solvent is present in the abovementioned buffer, for example 50% formamide, the temperature under standard conditions is approximately 42° C. The hybridization conditions for DNA:DNA hybrids are, preferably, 0.1× SSC and 20° C. to 45° C., preferably between 30° C. and 45° C. The hybridization conditions for DNA:RNA hybrids are, preferably, 0.1×SSC and 30° C. to 55° C., preferably between 45° C. and 55° C. The abovementioned hybridization temperatures are determined for example for a nucleic acid with approximately 100 bp (=base pairs) in length and a G+C content of 50% in the absence of formamide. The skilled worker knows how to determine the hybridization conditions required by referring to textbooks such as the textbook mentioned above, or the following textbooks: Sambrook et al., "Molecular Cloning", Cold Spring Harbor Laboratory, 1989; Hames and Higgins (Ed.) 1985, "Nucleic Acids Hybridization: A Practical Approach", IRL Press at Oxford University Press, Oxford; Brown (Ed.) 1991, "Essential Molecular Biology: A Practical Approach", IRL Press at Oxford University Press, Oxford. In an embodiment, stringent hybridization conditions encompass hybridization at 65° C. in 1×SSC, or at 42° C. in 1×SSC and 50% formamide, followed by washing at 65° C. in 0.3×SSC. In another embodiment, stringent hybridization conditions encompass hybridization at 65° C. in 1×SSC, or at 42° C. in 1×SSC and 50% formamide, followed by washing at 65° C. in 0.1×SSC. Alternatively, polynucleotide variants are obtainable by PCR-based techniques such as mixed oligonucleotide primer based amplification of DNA, i.e. using degenerated primers against conserved domains of the polypeptides of the present invention. Conserved domains of the polypeptide of the present invention may be identified by a sequence comparison of the nucleic acid sequences of the polynucleotides or the amino acid sequences of the polypeptides of the present invention. As a template, DNA or cDNA from bacteria, fungi, plants, or animals may be used. Further, variants include polynucleotides comprising nucleic acid sequences which are at least 50%, at least 55%, at least 60%, at least 65%, at least 70%, at least 75%, at least 80%, at least 85%, at least 90%, at least 95%, at least 98% or at least 99% identical to the nucleic acid coding sequences shown in any one of the T-DNA sequences given in Table 1 of the Examples, and in particular to polynucleotides encoding the desaturases or elongases referred to above, in particular the elongases and desaturases given in Table 2. E.g., polynucleotides are envisaged which are at least 50%, at least 55%, at least 60%, at least 65%, at least 70%, at least 75%, at least 80%, at least 85%, at least 90%, at least 95%, at least 98% or at least 99% identical to the polynucleotide encoding the delta-4-desaturase from *Thraustochytrium* sp (and thus to a polynucleotide having sequence as shown in nucleotides 26384 to 27943 of SEQ ID NO: 3). Of course, a variant as referred to herein must retain the function of the respective enzyme, e.g. a variant of a delta-4-desaturase must retain delta-4-desaturase activity, or a variant of a delta-12-desaturase must retain delta-12-desaturase activity.

The percent identity values are, preferably, calculated over the entire amino acid or nucleic acid sequence region. A series of programs based on a variety of algorithms is available to the skilled worker for comparing different sequences. In a preferred embodiment, the percent identity between two amino acid sequences is determined using the Needleman and Wunsch algorithm (Needleman 1970, J. Mol. Biol. (48):444-453) which has been incorporated into the needle program in the EMBOSS software package (EMBOSS: The European Molecular Biology Open Software Suite, Rice, P., Longden, I., and Bleasby, A, Trends in Genetics 16(6), 276-277, 2000), a BLOSUM62 scoring matrix, and a gap opening penalty of 10 and a gap extension pentalty of 0.5. Guides for local installation of the EMBOSS package as well as links to WEB-Services can be found at emboss.sourceforge.net. A preferred, non-limiting example of parameters to be used for aligning two amino acid sequences using the needle program are the default parameters, including the EBLOSUM62 scoring matrix, a gap opening penalty of 10 and a gap extension penalty of 0.5. In yet another preferred embodiment, the percent identity between two nucleotide sequences is determined using the needle program in the EMBOSS software package (EMBOSS: The European Molecular Biology Open Software Suite, Rice, P., Longden, I., and Bleasby, A, Trends in Genetics 16(6), 276-277, 2000), using the EDNAFULL scoring matrix and a gap opening penalty of 10 and a gap extension penalty of 0.5. A preferred, non-limiting example of parameters to be used in conjunction for aligning two nucleic acid sequences using the needle program are the default parameters, including the EDNAFULL scoring matrix, a gap opening penalty of 10 and a gap extension penalty of 0.5. The nucleic acid and protein sequences of the present invention can further be used as a "query sequence" to perform a search against public databases to, for example, identify other family members or related sequences. Such searches can be performed using the BLAST series of programs (version 2.2) of Altschul et al. (Altschul 1990, J. Mol. Biol. 215:403-10). BLAST using desaturase and elongase nucleic acid sequences of the invention as query sequence can be performed with the BLASTn, BLASTx or the tBLASTx program using default parameters to obtain either nucleotide sequences (BLASTn, tBLASTx) or amino acid sequences (BLASTx) homologous to desaturase and elongase sequences of the invention. BLAST using desaturase and elongase protein sequences of the invention as query sequence can be performed with the BLASTp or the tBLASTn program using default parameters to obtain either amino acid sequences (BLASTp) or nucleic acid sequences (tBLASTn) homologous to desaturase and elongase sequences of the invention. To obtain gapped alignments for comparison purposes, Gapped BLAST using default parameters can be utilized as described in Altschul et al. (Altschul 1997, Nucleic Acids Res. 25(17):3389-3402).

Preferred variants of the polynucleotides having a sequence shown in SEQ ID NO: 257, 259, 261, 263, 265, 267, 269, 271, 273, or 275 are described herein below.

Preferably, a variant of a polynucleotide encoding a desaturase or elongase as referred to herein is, preferably, a polynucleotide comprising a nucleic acid sequence selected from the group consisting of:

a) a nucleic acid sequence being at least 70%, 80%, or 90% identical to the nucleic acid sequence having a nucleotide sequence as shown in SEQ ID NOs: 257, 259, 261, 263, 265, 267, 269, 271, 273, or 275, b) a nucleic acid sequence encoding a polypeptide which is at least 70%, 80, or 90% identical to a polypeptide having an amino acid sequence as shown in SEQ ID NOs: 258, 260, 262, 264, 266, 268, 270, 272, 274, or 276, and c) a nucleic acid sequence which is capable of hybridizing under stringent conditions to i) a nucleic acid sequence having a nucleotide sequence as shown in SEQ ID NOs: 257, 259, 261, 263, 265, 267, 269, 271, 273, or 275, or to ii) a nucleic acid sequence encoding a polypeptide having an amino acid sequence as shown in SEQ ID NOs: 258, 260, 262, 264, 266, 268, 270, 272, 274, or 276.

As set forth above, the polypeptide encoded by said nucleic acid must retain the function and thus the activity of the respective enzyme. For example, the polypeptide having a sequence as shown in SEQ ID NO: 270 has omega-3-desaturase activity. Accordingly, the variant this polypeptide also shall have omega-3-desaturase activity.

Thus, a polynucleotide encoding a desaturase or elongase as referred to herein is, preferably, a polynucleotide comprising a nucleic acid sequence selected from the group consisting of:

a) a nucleic acid sequence having a nucleotide sequence as shown in SEQ ID NO: 257, 259, 261, 263, 265, 267, 269, 271, 273, or 275, b) a nucleic acid sequence encoding a polypeptide having an amino acid sequence as shown in SEQ ID NO: 258, 260, 262, 264, 266, 268, 270, 272, 274, or 276 c) a nucleic acid sequence being at least 70%, 80%, or 90% identical to the nucleic acid sequence having a nucleotide sequence as shown in SEQ ID NOs: 257, 259, 261, 263, 265, 267, 269, 271, 273, or 275, d) a nucleic acid sequence encoding a polypeptide which is at least 70%, 80, or 90% identical to a polypeptide having an amino acid sequence as shown in SEQ ID NOs: 258, 260, 262, 264, 266, 268, 270, 272, 274, or 276, and e) a nucleic acid sequence which is capable of hybridizing under stringent conditions to i) a nucleic acid sequence having a nucleotide sequence as shown in SEQ ID NOs: 257, 259, 261, 263, 265, 267, 269, 271, 273, or 275, or to ii) a nucleic acid sequence encoding a polypeptide having an amino acid sequence as shown in SEQ ID NOs: 258, 260, 262, 264, 266, 268, 270, 272, 274, or 276.

The event LBFLFK comprises two T-DNA insertions, the insertions being designated LBFLFK Locus 1 and LBFLFK Locus 2. Plants comprising this insertion were generated by transformation with the T-DNA vector having a sequence as shown in SEQ ID NO: 3. Sequencing of the insertions present in the plant revealed that each locus contained a point mutation in a coding sequence resulting in a single amino acid exchange. The mutations did not affect the function of the genes. Locus 1 has a point mutation in the coding sequence for the delta-12 desaturase from *Phythophthora sojae* (d12Des(Ps)). The resulting polynucleotide has a sequence as shown in SEQ ID NO: 324. Said polynucleotide encodes a polypeptide having a sequence as shown in SEQ ID NO: 325. Locus 2 has a point mutation in the coding sequence for the delta-4 desaturase from *Pavlova lutheri* (d4Des(Pl)). The resulting polynucleotide has a sequence as shown in SEQ ID NO: 326. Said polynucleotide encodes a polypeptide having a sequence as shown in SEQ ID NO: 327. The aforementioned polynucleotides are considered as variants of the polynucleotide encoding the delta-12 desaturase from *Phythophthora sojae* and the polynucleotide encoding the delta-4 desaturase from *Pavlova lutheri*. The polynucleotides are considered as variants and can be used in the context of the present invention.

A polynucleotide comprising a fragment of any nucleic acid, particularly of any of the aforementioned nucleic acid sequences, is also encompassed as a polynucleotide of the present invention. The fragments shall encode polypeptides which still have desaturase or elongase activity as specified above. Accordingly, the polypeptide may comprise or consist of the domains of the polypeptide of the present invention conferring the said biological activity. A fragment as meant herein, preferably, comprises at least 50, at least 100, at least 250 or at least 500 consecutive nucleotides of any one of the aforementioned nucleic acid sequences or encodes an amino acid sequence comprising at least 20, at least 30, at least 50, at least 80, at least 100 or at least 150 consecutive amino acids of any one of the aforementioned amino acid sequences.

The variant polynucleotides or fragments referred to above, preferably, encode polypeptides retaining desaturase or elongase activity to a significant extent, preferably, at least 10%, at least 20%, at least 30%, at least 40%, at least 50%, at least 60%, at least 70%, at least 80% or at least 90% of the desaturase or elongase activity exhibited by any of the polypeptides encoded by T-DNA given in the accompanying Examples (in particular of the desaturases or elongases listed in Table 1 and 2).

In order to express the polynucleotides encoding the desaturases or elongases as set forth in connection with the present invention, the polynucleotides shall be operably linked to expression control sequences. Preferably, the expression control sequences are heterologous with respect to the polynucleotides operably linked thereto. It is to be understood that each polynucleotide is operably linked to an expression control sequence.

The term "expression control sequence" as used herein refers to a nucleic acid sequence which is capable of governing, i.e. initiating and controlling, transcription of a nucleic acid sequence of interest, in the present case the nucleic sequences recited above. Such a sequence usually comprises or consists of a promoter or a combination of a promoter and enhancer sequences. Expression of a polynucleotide comprises transcription of the nucleic acid molecule, preferably, into a translatable mRNA. Additional regulatory elements may include transcriptional as well as translational enhancers. The following promoters and expression control sequences may be, preferably, used in an expression vector according to the present invention. The cos, tac, trp, tet, trp-tet, lpp, lac, lpp-lac, laclq, T7, T5, T3, gal, trc, ara, SP6, λ-PR or λ-PL promoters are, preferably, used in Gram-negative bacteria. For Gram-positive bacteria, promoters amy and SPO2 may be used. From yeast or fungal promoters ADC1, AOX1r, GAL1, MFa, AC, P-60, CYC1, GAPDH, TEF, rp28, ADH are, preferably, used. For animal cell or organism expression, the promoters CMV-, SV40-, RSV-promoter (Rous sarcoma virus), CMV-enhancer, SV40-enhancer are preferably used. From plants the promoters CaMV/35S (Franck 1980, Cell 21: 285-294], PRP1 (Ward 1993, Plant. Mol. Biol. 22), SSU, OCS, lib4, usp, STLS1, B33, nos or the ubiquitin or phaseolin promoter. Also preferred in this context are inducible promoters, such as the promoters described in EP 0388186 A1 (i.e. a benzylsulfonamide-inducible promoter), Gatz 1992, Plant J.

2:397-404 (i.e. a tetracyclin-inducible promoter), EP 0335528 A1 (i.e. a abscisic-acid-inducible promoter) or WO 93/21334 (i.e. a ethanol- or cyclohexenol-inducible promoter). Further suitable plant promoters are the promoter of cytosolic FBPase or the ST-LSI promoter from potato (Stockhaus 1989, EMBO J. 8, 2445), the phosphoribosyl-pyrophosphate amidotransferase promoter from *Glycine max* (Genbank accession No. U87999) or the node-specific promoter described in EP 0249676 A1. Particularly preferred are promoters which enable the expression in tissues which are involved in the biosynthesis of fatty acids. Also particularly preferred are seed-specific promoters such as the USP promoter in accordance with the practice, but also other promoters such as the LeB4, DC3, phaseolin or napin promoters. Further especially preferred promoters are seed-specific promoters which can be used for monocotyledonous or dicotyledonous plants and which are described in U.S. Pat. No. 5,608,152 (napin promoter from oilseed rape), WO 98/45461 (oleosin promoter from Arobidopsis, U.S. Pat. No. 5,504,200 (phaseolin promoter from *Phaseolus vulgaris*), WO 91/13980 (Bce4 promoter from *Brassica*), by Baeumlein et al., Plant J., 2, 2, 1992:233-239 (LeB4 promoter from a legume), these promoters being suitable for dicots. The following promoters are suitable for monocots: Ipt-2 or Ipt-1 promoter from barley (WO 95/15389 and WO 95/23230), hordein promoter from barley and other promoters which are suitable and which are described in WO 99/16890. In principle, it is possible to use all natural promoters together with their regulatory sequences, such as those mentioned above, for the novel process. Likewise, it is possible and advantageous to use synthetic promoters, either additionally or alone, especially when they mediate a seed-specific expression, such as, for example, as described in WO 99/16890. Preferably, the polynucleotides encoding the desaturases and elongases as referred to herein are expressed in the seeds of the plants. In a particular embodiment, seed-specific promoters are utilized in accordance with the present invention. In a particular preferred embodiment the polynucleotides encoding the desaturares or elongases are operably linked to expression control sequences used for the expression of the desaturases and elongases in the Examples section (see e.g. the promoters used for expressing the elongases and desaturases in VC-LTM593-1qcz rc. The sequence of this vector is shown in SEQ ID NO: 3, see also Table 1 in the Examples section).

The term "operatively linked" as used herein means that the expression control sequence and the nucleic acid of interest are linked so that the expression of the said nucleic acid of interest can be governed by the said expression control sequence, i.e. the expression control sequence shall be functionally linked to the said nucleic acid sequence to be expressed. Accordingly, the expression control sequence and, the nucleic acid sequence to be expressed may be physically linked to each other, e.g., by inserting the expression control sequence at the 5' end of the nucleic acid sequence to be expressed. Alternatively, the expression control sequence and the nucleic acid to be expressed may be merely in physical proximity so that the expression control sequence is capable of governing the expression of at least one nucleic acid sequence of interest. The expression control sequence and the nucleic acid to be expressed are, preferably, separated by not more than 500 bp, 300 bp, 100 bp, 80 bp, 60 bp, 40 bp, 20 bp, 10 bp or 5 bp.

Preferred polynucleotides of the present invention comprise, in addition to a promoter, a terminator sequence operatively linked to the nucleic acid sequence of interest. Thereby, an expression cassette is formed.

The term "terminator" as used herein refers to a nucleic acid sequence which is capable of terminating transcription. These sequences will cause dissociation of the transcription machinery from the nucleic acid sequence to be transcribed. Preferably, the terminator shall be active in plants and, in particular, in plant seeds. Suitable terminators are known in the art and, preferably, include polyadenylation signals such as the SV40-poly-A site or the tk-poly-A site or one of the plant specific signals indicated in Loke et al. (Loke 2005, Plant Physiol 138, pp. 1457-1468), downstream of the nucleic acid sequence to be expressed.

In a preferred embodiment, the polynucleotides encoding the desaturases or elongase referred to herein are recombinant.

The invention furthermore relates to recombinant nucleic acid molecules comprising at least one nucleic acid sequence which codes for a polypeptide having desaturase and/or elongase activity which is modified by comparison with the nucleic acid sequence in the organism from which the sequence originates in that it is adapted to the codon usage in one or more plant species.

For the purposes of the invention "recombinant" means with regard to, for example, a nucleic acid sequence, an expression cassette (=gene construct) or a vector comprising the nucleic acid sequences used in the process according to the invention or a host cell transformed with the nucleic acid sequences, expression cassette or vector used in the process according to the invention, all those constructions brought about by recombinant methods in which either the nucleic acid sequence, or a genetic control sequence which is operably linked with the nucleic acid sequence, for example a promoter, or are not located in their natural genetic environment or have been modified by recombinant methods.

The definitions given herein above preferably apply to the following:

As set forth above, the present invention relates to a method for increasing the tocopherol content of a plant relative to a control plant, comprising expressing in a plant at least one polynucleotide encoding a delta-12-desaturase, at least one polynucleotide encoding a delta-6-desaturase, at least one polynucleotide encoding a delta-6-elongase, and at least one polynucleotide encoding a delta-5-desaturase. In an embodiment, the method further comprises the expression of at least one polynucleotide encoding an omega-3-desaturase, at least one polynucleotide encoding a delta-5-elongase, and/or at least one polynucleotide encoding a delta-4-desaturase (for more details regarding the method of the present invention, see section "SUMMARY OF THE INVENTION", the definitions and explanations apply accordingly). Preferably, the polynucleotides are expressed from expression cassettes.

The invention is also concerned with providing polynucleotides as set forth in connection with the method of the present invention, constructs or T-DNAs for establishing high tocopherol content in plants or parts thereof, particularly in plant oils.

The construct or T-DNA shall comprise expression cassettes for the polynucleotides as set forth in the context of the method of the present invention for increasing the tocopherol content. The construct or T-DNA can be used in connection with the method the present invention. In an embodiment, said construct or T-DNA is introduced into the plant for expressing the said polynucleotides (for increasing the tocopherol content).

Accordingly, the present invention relates to a construct or T-DNA comprising at least one expression cassette for a delta-12-desaturase, at least one expression cassette for a delta-6-desaturase, at least one expression cassette for a delta-6-elongase, and at least one expression cassette for a delta-5-desaturase.

An expression cassette for expression of a gene (herein also referred to as target gene) shall comprise the polynucleotide encoding the respective enzyme (i.e. a desaturase or an elongase) operatively linked to a promoter (expression control sequence). Preferably, the expression cassette further comprises a terminator. Preferably, the terminator is downstream of the polynucleotide encoding the desaturase or elongase.

In an embodiment, the construct or T-DNA further comprises at least one expression cassette for an omega-3-desaturase.

In an embodiment, the construct or T-DNA further comprises at least one expression cassette for a delta-5-elongase.

In an embodiment, the construct or T-DNA further comprises at least one expression cassette for a delta-4-desaturase.

In an embodiment, the construct or T-DNA further comprises at least one expression cassette for a delta-15-desaturase.

In a preferred embodiment, the construct or T-DNA further comprises at least one expression cassette for an omega-3-desaturase, at least one expression cassette for a delta-5-elongase, and at least one expression cassette for a delta-4-desaturase (preferably at least one for a Coenzyme A dependent delta-4 desaturase and at least one for a phospholipid dependent delta-4 desaturase).

In a particularly preferred embodiment, the T-DNA or construct comprises at least one expression cassette for a delta-12-desaturase, at least one expression cassette for a delta-6-desaturase, at least two expression cassettes for a delta-6-elongase, at least two expression cassettes for a delta-5-desaturase, and optionally at least three expression cassettes for an omega-3-desaturase, and at least one expression cassette for a delta-5-elongase, and at least two expression cassettes for a delta-4-desaturase (preferably for one CoA (Coenzyme A)-dependent D4Des and for one Phospholipid-dependent d4Des.)

In another preferred embodiment, the T-DNA or construct comprises at least one expression cassette for a delta-6 elongase from *Physcomitrella patens*, at least one expression cassette for a delta-12 desaturase from *Phythophthora sojae*, at least one expression cassette for a delta-6 desaturase from *Ostreococcus tauri*, at least one expression cassette for a delta-6 elongase from *Thalassiosira pseudonana*, at least one expression cassette (in particular at least two) expression cassette(s) for a delta-5 desaturase from *Thraustochytrium* sp., and optionally at least one expression cassette (in particular at least two) expression cassette(s) for an omega-3 desaturase from *Pythium irregulare*, at least one expression cassette for an omega-3-desaturase from *Phythophthora infestans*, at least one expression cassette for a delta-5 elongase from *Ostreococcus tauri*, and at least one expression cassette for a delta-4 desaturase from *Thraustochytrium* sp., and at least one expression cassette for a delta-4 desaturase from *Pavlova lutheri*.

Also preferably, the T-DNA or construct comprises the sequence of the T-DNA in the T-DNA vector VC-LTM593-1qcz described in the Examples section. This vector comprises a sequence shown in SEQ ID NO: 3.

Thus, the invention provides a T-DNA for expression of a target gene in a plant, wherein the T-DNA comprises a left and a right border element and at least one expression cassette comprising a promoter, operatively linked thereto a target gene, and downstream thereof a terminator (and thus at least the expression cassette referred to above), wherein the length of the T-DNA, measured from left to right border element and comprising the target gene, has a length of at least 30000 bp. In an embodiment, the expression cassette is separated from the closest border of the T-DNA by a separator of at least 500 bp length.

In an embodiment, the T-DNA or construct of the present invention may comprise a separator between the expression cassettes encoding for the desaturases or elongases referred to above. Preferably, the expression cassettes are separated from each other by a separator of at least 100 base pairs, preferably of 100 to 200 base pairs. Thus, there is a separator between each expression cassette.

The invention thus provides nucleic acids, i.e. polynucleotides. A polynucleotide according to the present invention is or comprises a T-DNA or construct according to the present invention. Thus, a T-DNA according to the present invention is a polynucleotide, preferably a DNA, and most preferably a double stranded DNA. A "T-DNA" according to the invention is a nucleic acid capable of eventual integration into the genetic material (genome) of a plant. The skilled person understands that for such integration a transformation of respective plant material is required, preferred transformation methods and plant generation methods are described herein.

According to the invention also provided are nucleic acids comprising a T-DNA or construct as defined according to the present invention. For example, a T-DNA of the present invention may be comprised in a circular nucleic acid, e.g. a plasmid, such that an additional nucleic acid section is present between the left and right border elements, i.e. "opposite" of the expression cassette(s) according to the present invention. Such circular nucleic acid may be mapped into a linear form using an arbitrary starting point, e.g. such that the definition "left border element—expression cassette—right border element—additional nucleic acid section opposite of the expression cassette" defines the same circular nucleic acid as the definition "expression cassette—right border element—additional nucleic acid section opposite of the expression cassette—left border element". The additional nucleic acid section preferably comprises one or more genetic elements for replication of the total nucleic acid, i.e. the nucleic acid molecule comprising the T-DNA and the additional nucleic acid section, in one or more host microorganisms, preferably in a microorganism of genus *Escherichia*, preferably *E. coli*, and/or *Agrobacterium*. Preferable host microorganisms are described below in more detail. Such circular nucleic acids comprising a T-DNA of the present invention are particularly useful as transformation vectors; such vectors and are described below in more detail.

The polynucleotides as referred to herein are preferably expressed in a plant after introducing them into a plant. Thus, the method of the present invention may also comprise the step of introducing the polynucleotides into the plant. Preferably, the polynucleotides are introduced into the plant by transformation, in particular by *Agrobacterium*-mediated transformation. In an embodiment, the plants are transformed with a construct or T-DNA comprising the polynucleotides and/or expression cassette as set forth in connect with the present invention. Thus, it is envisaged that the plant is (has been) transformed with a T-DNA or construct of the present invention. The construct or T-DNA used for the introduction, preferably comprises all polynucleotides to be expressed. Thus, a single construct or T-DNA shall be used for transformation.

The T-DNA or construct length is, thus, preferably large, i.e. may have a minimum length of at least 15000 bp, preferably more than 30000 bp, more preferably at least 40000 bp, even more preferably at least 50000 bp and most preferably at least 60000 bp. Preferably, the length of the T-DNA is in a range of any of the aforementioned minimum lengths to 120000 bp, more preferably in a range of any of the aforementioned minimum lengths to 100000 bp, even more preferably in a range of any of the aforementioned minimum lengths to 90000 bp, even more preferably in a range of any of the aforementioned minimum lengths to 80000 bp. With such minimum lengths it is possible to introduce a number of genes in the form of expression cassettes such that each individual gene is operably liked to at least one promoter and at least one terminator.

In an embodiment, in 3' direction of the T-DNA left border element or in 5' direction of the T-DNA right border element, a separator is present setting the respective border element apart from the expression cassette comprising the target gene. The separator in 3' direction of the T-DNA left border element does not necessarily have the same length and/or sequence as the separator in 5' direction of the T-DNA right border element, as long as both separators suffice to the further requirements given below.

In another embodiment, the expression cassettes are separated from each other by a separator of at least 100 base pairs, preferably of 100 to 200 base pairs. Thus, there is a separator between the expression cassettes.

The separator or spacer is a section of DNA predominantly defined by its length. Its function is to separate a target gene from the T-DNA's left or right border, respectively., Introducing a separator effectively separates the gene of interest from major influences exerted by the neighbouring genomic locations after insertion of the T-DNA into a genomic DNA. For example it is commonly believed that not all genomic loci are equally suitable for expression of a target gene, and that the same gene under the control of the same promoter and terminator may be expressed in different intensity in plants depending on the region of integration of the target gene (and its corresponding promoter and terminator) in the plant genome. It is generally believed that different regions of a plant genome are accessible with differing ease for transcription factors and/or polymerase enzymes, for example due to these regions being tightly wound around histones and/or attached to the chromosomal backbone (cf. for example Deal et al., Curr Opin Plant Biol. April 2011; 14(2): 116-122) or other scaffold material (cf. e.g. Fukuda Y., Plant Mol Biol. 1999 March; 39(5): 1051-62). The mechanism of achieving the above-mentioned benefits by the T-DNA of the present invention is not easily understood, so it is convenient to think of the spacer as a means for physically providing a buffer to compensate for strain exerted by DNA winding by neighbouring histones or chromosomal backbone or other scaffold attached regions. As a model it can be thought that to transcribe a target gene, the DNA has to be partially unwound. If neighbouring regions of the target gene resist such unwinding, for example because they are tightly wound around histones or otherwise attached to a scaffold or backbone such that rotation of nucleic acid strands is limited, the spacer allows to distribute the strain created by the unwinding attempt over a longer stretch of nucleic acid, thereby reducing the force required for unwinding at the target gene.

In an embodiment, the separator has a length of at least 500 bp. The separator, thus, can be longer than 500 bp, and preferably is at least 800 bp in length, more preferably at least 1000 bp. Longer spacers allow for even more physical separation between the target gene and the nearest genomic flanking region.

In another embodiment, the spacer has a length of at least 100 bp. Preferably, the spacer has a length of 100 to 200 base pairs.

The separator preferably has a sequence devoid of matrix or scaffold attachment signals. Preferably, the separator or spacer does not comprise more than once for a length of 500 bp, preferably not more than once for a length of 1000 bp, a 5-tuple which occurs in the spacers for 20 or more times, summarized over all spacers given in the examples. Those 5-tuples are, in increasing frequency in the spacers given in the examples: AGCCT, CGTAA, CTAAC, CTAGG, GTGAC, TAGGC, TAGGT, AAAAA, AACGC, TTAGC, ACGCT, GCTGA, ACGTT, AGGCT, CGTAG, CTACG, GACGT, GCTTA, AGCTT, CGCTA, TGACG, ACGTG, AGCTG, CACGT, CGTGA, CGTTA, AGCGT, TCACG, CAGCT, CGTCA, CTAGC, GCGTC, TTACG, GTAGC, TAGCG, TCAGC, TAGCT, AGCTA, GCTAG, ACGTA, TACGT. By reducing the frequency of occurrence of one or more of the aforelisted 5-tuples compared to the separators or spacers, a further increase in expression of a target gene in the T-DNA can be achieved.

The separator may contain a selectable marker. A selectable marker is a nucleic acid section whose presence preferably can be verified in seed without having to wait for the sprouting or full growth of the plant. Preferably the selectable marker conveys a phenotypical property to seed or to a growing plant, for example herbicide tolerance, coloration, seed surface properties (e.g. wrinkling), luminescence or fluorescence proteins, for example green fluorescent protein or luciferase. If for exhibiting the phenotypical feature an expression of a marker gene is required, then the separator correspondingly comprises the marker gene as a selectable marker, preferably in the form of an expression cassette. Inclusion of a selectable marker in the separator is particularly advantageous since the marker allows easy discard of non-transformant plant material. Also, in such unexpected case where the T-DNA integrates in a location of the plant genome where the length and/or nucleobase composition of the spacer is insufficient to overcome gene silencing effects caused by the neighbouring genomic DNA, the selectable marker allows easy discard of such unfortunately badly performing exceptional transformants. Thus, preferably the separator comprises an expression cassette for expression of an herbicide tolerance gene. Such separator greatly reduces the chance of having to cultivate a transformant where silencing effects are so strong that even the expression of the selectable marker gene is greatly reduced or fully inhibited. According to the invention, the separator preferably does not comprise a desaturase or elongase gene, and also preferably does not comprise a promoter or operatively linked to a desaturase or elongase gene. Thus, the T-DNA of the present invention in preferred embodiments is useful for effective separation of the desaturase and elongase genes essential for the production of VLC-PUFAs from any influence of effects caused by neighbouring genomic plant DNA.

For increasing the tocopherol content (and for the production of VLC-PUFAs) in plants, the invention also provides a construct or a T-DNA comprising the coding sequences (in particular of the desaturases and elogases) as given in Table 1 and 2 in the examples, preferably comprising the coding sequences (in particular of the desaturases and elogases) and promoters as given in Table 1 in the examples, more preferably the coding sequences (in particular of the desaturases and elongases) and promoters and terminators as given in Table 1 in the examples, and most preferably the expression cassettes for the desaturases and elongases as referred to in the context of the method of present invention as present in VC-LTM593-1qcz rc (see Examples section, SEQ ID NO: 3).

The present invention furthermore relates to a plant comprising the polynucleotides as referred to herein in the context of the method of the present invention for increasing the tocopherol content, or the T-DNA or construct of the present invention. Furthermore, the present invention relates to a seed of the plant. Said seed shall comprised the said polynucleotides. In an embodiment, the said polynucleotides are comprised by the same T-DNA.

In addition, the present invention relates to Brassica plant, or a seed thereof, having in increased tocopherol content a compared to a control plant, in particular having an increased tocopherol content the seeds as compared to the seeds of control plants. In an embodiment, said plant is a Brassica napus plant. Said plant shall be transgenic.

In a preferred embodiment, the seed of the present invention shall comprise an oil as described herein below in more detail.

The plant of the invention shall comprise one or more T-DNA or construct of the present invention. Thus, the plant shall comprise at least T-DNA or construct of the present invention. Moreover, it is envisaged that the plant of the present invention comprises the polynucleotides encoding desaturases as set forth in the context of the method of the present invention of increasing the tocopherol content.

Preferably, the T-DNA or construct comprised by the plant comprises one or more expression cassettes encoding for one or more d6Des (delta 6 desaturase), one or more d6Elo (delta 6 elongase), one or more d5Des (delta 5 desaturase), or one more d12Des (delta 12 desaturase). In an embodiment, the T-DNA or construct comprised by the plant of the present invention, further comprises expression cassettes for one or more o3Des (omega 3 desaturase), one or more d5Elo (delta 5 elongase) and/or one or more d4Des (delta 4 desaturase), preferably for at least one CoA (Coenzyme A)-dependent D4Des and one Phospholipid-dependent d4Des.

Three desaturase genes are particularly prone to gene dosage effects (also called "copy number effects"), such that increasing the number of expression cassettes comprising these respective genes leads to a stronger increase in VLC-PUFA levels in plant oils than increasing the number of expression cassettes of other genes. These genes are the genes coding for delta-12-desaturase activity, for delta-6-desaturase activity and omega-3-desaturase activity. It is to be understood that where the T-DNA of the present invention comprises more than one expression cassette comprising a gene of the same function, these genes do not need to be identical concerning their nucleic acid sequence or the polypeptide sequence encoded thereby, but should be functional homologs. Thus, for example, to make use of the gene dosage effect described herein a T-DNA according to the present invention may comprise, in addition to optionally a multiplicity of genes coding for delta-6-desaturases and/or omega-3-desaturases, two, three, four or more expression cassettes each comprising a gene coding for a delta-12-desaturase, wherein the delta-12-desaturase polypeptides coded by the respective genes differ in their amino acid sequence. Likewise, a T-DNA of the present invention may comprise, in addition to optionally a multiplicity of genes coding for delta-12-desaturases and/or omega-3-desaturases, two, three, four or more expression cassettes each comprising a gene coding for a delta-6-desaturase, wherein the delta-6-desaturase polypeptides coded by the respective genes differ in their amino acid sequence, or a T-DNA of the present invention may comprise, in addition to optionally a multiplicity of genes coding for delta-12-desaturases and/or delta-6-desaturases, two, three, four or more expression cassettes each comprising a gene coding for a omega-3-desaturase, wherein the omega-3-desaturase polypeptides coded by the respective genes differ in their amino acid sequence.

According to the invention, the T-DNA, construct or plant may also comprise, instead of one or more of the aforementioned coding sequences, a functional homolog thereof. A functional homolog of a coding sequence is a sequence coding for a polypeptide having the same metabolic function as the replaced coding sequence. For example, a functional homolog of a delta-5-desaturase would be another delta-5-desaturase, and a functional homolog of a delta-5-elongase would be another delta-5-elongase. The functional homolog of a coding sequence preferably codes for a polypeptide having at least 40% sequence identity to the polypeptide coded for by the corresponding coding sequence given Table 1 of the examples, more preferably at least 41%, more preferably at least 46%, more preferably at least 48%, more preferably at least 56%, more preferably at least 58%, more preferably at least 59%, more preferably at least 62%, more preferably at least 66%, more preferably at least 69%, more preferably at least 73%, more preferably at least 75%, more preferably at least 77%, more preferably at least 81%, more preferably at least 84%, more preferably at least 87%, more preferably at least 90%, more preferably at least 92%, more preferably at least 95%, more preferably at least 96%, more preferably at least 97%, more preferably at least 98% and even more preferably at least 99%. Likewise, a functional homolog of a promoter is a sequence for starting transcription of a coding sequence located within 500 bp for a proximal promoter or, for a distal promoter, within 3000 bp distant from the promoter TATA box closest to the coding sequence. Again, a functional homolog of a plant seed specific promoter is another plant seed specific promoter. The functional homolog of a terminator, correspondingly, is a sequence for ending transcription of a nucleic acid sequence.

The Examples describe a particularly preferred T-DNA sequence. The skilled person understands that the coding sequences, promoters and terminators described therein can be replaced by their functional homologs. However, the Examples also describe that according to the invention, certain combinations of promoters and coding sequences, or certain combinations of promoters driving the expression of their corresponding coding sequences, or certain coding sequences or combinations thereof are particularly advantageous; such combinations or individual coding sequences should according to the invention not be replaced by functional homologs of the respective element (here: coding sequence or promoter). Preferred promoter-coding sequence-terminator combinations are shown in Table 1.

A T-DNA or construct of the present invention may comprise two or more genes, preferably all genes, susceptible to a gene dosage effect. As described herein, it is advantageous for achieving high conversion efficiencies of certain enzymatic activities, e.g. delta-12-desaturase, delta-6-desaturase and/or omega-3-desaturase activity, to introduce more than one gene coding for an enzyme having the desired activity into a plant cell. When introducing T-DNA into plant cells, generally transformation methods involving exposition of plant cells to microorganisms are employed, e.g. as described herein. As each microorganism may comprise more than one nucleic acid comprising a T-DNA of the present invention, recombinant plant cells are frequently obtained comprising two or more T-DNAs of the present invention independently integrated into the cell's genetic material. Thus, by combining genes susceptible to a gene dosage effect on one construct for transformation allows to easily exploit the independence of transformations to achieve a higher frequency of multiple insertions of such T-DNAs. This is particularly useful for transformation methods relying on co-transformation to keep the size of each construct to be transformed low.

The invention accordingly also provides a construct comprising a T-DNA according to the present invention, wherein the construct preferably is a vector for transformation of a plant cell by microorganism-mediated transformation, preferably by *Agrobacterium*-mediated transformation. Correspondingly, the invention also provides a transforming microorganism comprising one T-DNA according to the present invention, preferably as a construct comprising said T-DNA. Preferably the microorganism is of genus *Agrobacterium*, preferably a disarmed strain thereof, and preferably of species *Agrobacterium tumefaciens* or, even more preferably, of species *Agrobacterium rhizogenes*. Corresponding strains are for example described in WO06024509A2, and methods for plant transformation using such microorganisms are for example described in WO13014585A1. These WO publications are incorporated herein in their entirety, because they contain valuable information about the creation, selection and use of such microorganisms.

The term "vector", preferably, encompasses phage, plasmid, viral vectors as well as artificial chromosomes, such as bacterial or yeast artificial chromosomes. Moreover, the term also relates to targeting constructs which allow for random or site-directed integration of the targeting construct into genomic DNA. Such target constructs, preferably, comprise DNA of sufficient length for either homolgous or heterologous recombination as described in detail below. The vector encompassing the polynucleotide of the present invention, preferably, further comprises selectable markers for propagation and/or selection in a host. The vector may be incorporated into a host cell by various techniques well known in the art. If introduced into a host cell, the vector may reside in the cytoplasm or may be incorporated into the genome. In the latter case, it is to be understood that the vector may further comprise nucleic acid sequences which allow for homologous recombination or heterologous insertion. Vectors can be introduced into prokaryotic or eukaryotic cells via conventional transformation or transfection techniques. The terms "transformation" and "transfection", conjugation and transduction, as used in the present context, are intended to comprise a multiplicity of prior-art processes for introducing foreign nucleic acid (for example DNA) into a host cell, including calcium phosphate, rubidium chloride or calcium chloride co-precipitation, DEAE-dextran-mediated transfection, lipofection, natural competence, carbon-based clusters, chemically mediated transfer, electroporation or particle bombardment. Suitable methods for the transformation or transfection of host cells, including plant cells, can be found in Sambrook et al. (Molecular Cloning: A Laboratory Manual, 2nd ed., Cold Spring Harbor Laboratory, Cold Spring Harbor Laboratory Press, Cold Spring Harbor, N.Y., 1989) and other laboratory manuals, such as Methods in Molecular Biology, 1995, Vol. 44, *Agrobacterium* protocols, Ed.: Gartland and Davey, Humana Press, Totowa, N.J. Alternatively, a plasmid vector may be introduced by heat shock or electroporation techniques. Should the vector be a virus, it may be packaged in vitro using an appropriate packaging cell line prior to application to host cells.

Preferably, the vector referred to herein is suitable as a cloning vector, i.e. replicable in microbial systems. Such vectors ensure efficient cloning in bacteria and, preferably, yeasts or fungi and make possible the stable transformation of plants. Those which must be mentioned are, in particular, various binary and co-integrated vector systems which are suitable for the T DNA-mediated transformation. Such vector systems are, as a rule, characterized in that they contain at least the vir genes, which are required for the *Agrobacterium*-mediated transformation, and the sequences which delimit the T-DNA (T-DNA border). These vector systems, preferably, also comprise further cis-regulatory regions such as promoters and terminators and/or selection markers with which suitable transformed host cells or organisms can be identified. While co-integrated vector systems have vir genes and T-DNA sequences arranged on the same vector, binary systems are based on at least two vectors, one of which bears vir genes, but no T-DNA, while a second one bears T-DNA, but no vir gene. As a consequence, the last-mentioned vectors are relatively small, easy to manipulate and can be replicated both in *E. coli* and in *Agrobacterium*. These binary vectors include vectors from the pBIB-HYG, pPZP, pBecks, pGreen series. Preferably used in accordance with the invention are Bin19, pBI101, pBinAR, pGPTV and pCAMBIA. An overview of binary vectors and their use can be found in Hellens et al, Trends in Plant Science (2000) 5, 446-451. Furthermore, by using appropriate cloning vectors, the polynucleotides can be introduced into host cells or organisms such as plants or animals and, thus, be used in the transformation of plants, such as those which are published, and cited, in: Plant Molecular Biology and Biotechnology (CRC Press, Boca Raton, Fla.), chapter 6/7, pp. 71-119 (1993); F. F. White, Vectors for Gene Transfer in Higher Plants; in: Transgenic Plants, vol. 1, Engineering and Utilization, Ed.: Kung and R. Wu, Academic Press, 1993, 15-38; B. Jenes et al., Techniques for Gene Transfer, in: Transgenic Plants, vol. 1, Engineering and Utilization, Ed.: Kung and R. Wu, Academic Press (1993), 128-143; Potrykus 1991, Annu. Rev. Plant Physiol. Plant Molec. Biol. 42, 205-225.

More preferably, the vector of the present invention is an expression vector. In such an expression vector, i.e. a vector which comprises the polynucleotide of the invention having the nucleic acid sequence operatively linked to an expression control sequence (also called "expression cassette") allowing expression in plant cells or isolated fractions thereof.

Most important, the invention also provides a plant or seed thereof, comprising, integrated in its genome, a construct or T-DNA of the present invention.

Thus, the construct or T-DNA shall be stably integrated into the genome of the plant or plant cell. The present invention, thus, relates to a plant comprising the T-DNA or construct of the present invention.

Such T-DNA or construct preferably allows for the expression of all genes required for increasing the tocopherol content in plants and particularly in the seeds thereof, particularly in oilseed plants, and most beneficially in plants or seeds of family Brassicaceae, preferably of genus *Brassica* and most preferably of a species comprising a genome of one or two members of the species *Brassica oleracea, Brassica nigra* and *Brassica rapa*, thus preferably of the species *Brassica napus, Brassica carinata, Brassica juncea, Brassica oleracea, Brassica nigra* or *Brassica rapa*. Particularly preferred according to the invention are plants and seeds of the species *Brassica napus* and *Brassica carinata*.

The plants of the present invention are necessarily transgenic, i.e. they comprise genetic material not present in corresponding wild type plant or arranged differently in corresponding wild type plant, for example differing in the number of genetic elements. For example, the plants of the present invention comprise promoters also found in wild type plants, but the plants of the present invention comprise such promoter operatively linked to a coding sequence such that this combination of promoter and coding sequence is not found in the corresponding wild type plant. Accordingly, the polynucleotide encoding for the desaturases or elongases shall be recombinant polynucleotides.

The plants and seeds of the present invention differ from hitherto produced plants in their production of a high content of tocopherol (and preferably of VLC-PUFAs), see Examples. In particular, the combinations of polynucleotides encoding the elongases or desaturases as set forth in connection with the method of the present invention, the constructs and T-DNAs of the present invention allow for the generation of transformant plants (also called "recombinant plants") and seeds thereof with a high transformation frequency, with a high stability of T-DNA insertions over multiple generations of self-fertilized plants, unchanged or unimpaired phenotypical and agronomic characteristics, with high amounts and concentration of tocopherol, and with high amounts and concentration of VLC-PUFAs, particularly EPA and/or DHA, in the oil of populations of such transformed plants and their corresponding progeny.

Unless stated otherwise, a plant of the present invention comprising a T-DNA or construct of the present invention can also be a plant comprising a part of a T-DNA or construct of the present invention, where such part is sufficient for the production of a desaturase and/or elongase coded for in the corresponding full T-DNA or construct of the present invention. Such plants most preferably comprise at least one full T-DNA of the present invention in addition to the part of a T-DNA of the present invention as defined in the previous sentence. Such plants are hereinafter also termed "partial double copy" plants. Event LBFDAU is an example of a plant comprising a part of a T-DNA of the present invention, and still being a plant of the present invention. In one embodiment the T_DNA is a full T-DNA.

Preferred plants of the present invention comprise one or more T-DNA(s) or construct(s) of the present invention comprising expression cassettes comprising, one or more genes encoding for one or more d5Des, one or more d6Elo, one or more d6Des, and one or more d12Des. In one embodiment, at least one T-DNA or vector further comprises (an) expression cassette(s) which comprises one or more genes encoding for one or more d5Elo, one or more o3Des, one or more d15Des, and/or one or more D4Des, preferably for at least one CoA-dependent D4Des and one Phospholipid-dependent d4Des. In one embodiment, the T-DNA or T-DNAs comprise one or more expression cassettes encoding d6Elo(Tp_GA) and/or d6Elo(Pp_GA). d6Elo(Tp_GA) is a Delta-6 elongase from *Thalassiosira pseudonana*, d6Elo (Pp_GA) is a Delta-6 elongase from *Physcomitrella patens*.

Preferably, the plant (or plant cell) of the present invention is an oilseed crop plant (or an oilseed crop plant cell). More preferably, said oilseed crop is selected from the group consisting of flax (*Linum* sp.), rapeseed (*Brassica* sp.), soybean (*Glycine* and *Soja* sp.), sunflower (*Helianthus* sp.), cotton (*Gossypium* sp.), corn (*Zea mays*), olive (*Olea* sp.), safflower (*Carthamus* sp.), cocoa (*Theobroma cacoa*), peanut (*Arachis* sp.), hemp, camelina, crambe, oil palm, coconuts, groundnuts, sesame seed, castor bean, lesquerella, tallow tree, sheanuts, tungnuts, kapok fruit, poppy seed, jojoba seeds and perilla. Preferred plants to be used for introducing the polynucleotide or T-DNA of the invention are plants which are capable of synthesizing fatty acids, such as all dicotyledonous or monocotyledonous plants, algae or mosses. Preferred plants are selected from the group of the plant families Adelotheciaceae, Anacardiaceae, Arecaceae, Asteraceae, Apiaceae, Betulaceae, Boraginaceae, Brassicaceae, Bromeliaceae, Caricaceae, Cannabaceae, Convolvulaceae, Chenopodiaceae, Compositae, Crypthecodiniaceae, Cruciferae, Cucurbitaceae, Ditrichaceae, Elaeagnaceae, Ericaceae, Euphorbiaceae, Fabaceae, Geraniaceae, Gramineae, Juglandaceae, Lauraceae, Leguminosae, Linaceae, Malvaceae, Moringaceae, Marchantiaceae, Onagraceae, Olacaceae, Oleaceae, Papaveraceae, Piperaceae, Pedaliaceae, Poaceae, Solanaceae, Prasinophyceae or vegetable plants or ornamentals such as *Tagetes*. Examples which may be mentioned are the following plants selected from the group consisting of: Adelotheciaceae such as the genera *Physcomitrella*, such as the genus and species *Physcomitrella patens*, Anacardiaceae such as the genera *Pistacia, Mangifera, Anacardium*, for example the genus and species *Pistacia vera* [pistachio], *Mangifer indica* [mango] or *Anacardium occidentale* [cashew], Asteraceae, such as the genera *Calendula, Carthamus, Centaurea, Cichorium, Cynara, Helianthus, Lactuca, Locusta, Tagetes, Valeriana*, for example the genus and species *Calendula officinalis* [common marigold], *Carthamus tinctorius* [safflower], *Centaurea cyanus* [cornflower], *Cichorium intybus* [chicory], *Cynara scolymus* [artichoke], *Helianthus annus* [sunflower], *Lactuca sativa, Lactuca crispa, Lactuca esculenta, Lactuca scariola* L. ssp. *sativa, Lactuca scariola* L. var. *integrate, Lactuca scariola* L. var. *integrifolia, Lactuca sativa* subsp. *romana, Locusta communis, Valeriana locusta* [salad vegetables], *Tagetes lucida, Tagetes erecta* or *Tagetes tenuifolia* [african or french marigold], Apiaceae, such as the genus *Daucus*, for example the genus and species *Daucus carota* [carrot], Betulaceae, such as the genus *Corylus*, for example the genera and species *Corylus avellana* or *Corylus colurna* [hazelnut], Boraginaceae, such as the genus *Borago*, for example the genus and species *Borago officinalis* [borage], Brassicaceae, such as the genera *Brassica, Melanosinapis, Sinapis, Arabadopsis*, for example the genera and species *Brassica napus, Brassica rapa* ssp. [oilseed rape], *Sinapis arvensis Brassica juncea, Brassica juncea* var. *juncea, Brassica juncea* var. *crispifolia, Brassica juncea* var. *foliosa, Brassica nigra, Brassica sinapioides, Melanosinapis communis* [mustard], *Brassica oleracea* [fodder beet] or *Arabidopsis thaliana*, Bromeliaceae, such as the genera *Anana, Bromelia* (pineapple), for example the genera and species *Anana comosus, Ananas ananas* or *Bromelia comosa* [pineapple], Caricaceae, such as the genus *Carica*, such as the genus and species *Carica papaya* [pawpaw], Cannabaceae, such as the genus *Cannabis*, such as the genus and species *Cannabis sativa* [hemp], Convolvulaceae, such as the genera *Ipomea, Convolvulus*, for example the genera and species *Ipomoea batatus, Ipomoea pandurata, Convolvulus batatas, Convolvulus tiliaceus, Ipomoea fastigiata, Ipomoea tiliacea, Ipomoea triloba* or *Convolvulus panduratus* [sweet potato, batate], Chenopodiaceae, such as the genus *Beta*, such as the genera and species *Beta vulgaris, Beta vulgaris* var. *altissima, Beta vulgaris* var. *Vulgaris, Beta maritima, Beta vulgaris* var. *perennis, Beta vulgaris* var. *conditiva* or *Beta vulgaris* var. *esculenta* [sugarbeet], Crypthecodiniaceae, such as the genus *Crypthecodinium*, for example the genus and species *Cryptecodinium cohnii*, Cucurbitaceae, such as the genus *Cucurbita*, for example the genera and species *Cucurbita maxima*, *Cucurbita mixta*, *Cucurbita pepo* or *Cucurbita moschata* [pumpkin/squash], Cymbellaceae such as the genera *Amphora*, *Cymbella*, *Okedenia*, *Phaeodactylum*, *Reimeria*, for example the genus and species *Phaeodactylum tricornutum*, Ditrichaceae such as the genera *Ditrichaceae*, *Astomiopsis*, *Ceratodon*, *Chrysoblastella*, *Ditrichum*, *Distichium*, *Eccremidium*, *Lophidion*, *Philibertiella*, *Pleuridium*, *Saelania*, *Trichodon*, *Skottsbergia*, for example the genera and species *Ceratodon antarcticus*, *Ceratodon columbiae*, *Ceratodon heterophyllus*, *Ceratodon purpureus*, *Ceratodon purpureus*, *Ceratodon purpureus* ssp. *convolutus*, *Ceratodon*, *purpureus* spp. *stenocarpus*, *Ceratodon purpureus* var. *rotundifolius*, *Ceratodon ratodon*, *Ceratodon stenocarpus*, *Chrysoblastella chilensis*, *Ditrichum ambiguum*, *Ditrichum brevisetum*, *Ditrichum crispatissimum*, *Ditrichum difficile*, *Ditrichum falcifolium*, *Ditrichum flexicaule*, *Ditrichum giganteum*, *Ditrichum heteromallum*, *Ditrichum lineare*, *Ditrichum lineare*, *Ditrichum montanum*, *Ditrichum montanum*, *Ditrichum pallidum*, *Ditrichum punctulatum*, *Ditrichum pusillum*, *Ditrichum pusillum* var. *tortile*, *Ditrichum rhynchostegium*, *Ditrichum schimperi*, *Ditrichum tortile*, *Distichium capillaceum*, *Distichium hagenii*, *Distichium inclinatum*, *Distichium macounii*, *Eccremidium floridanum*, *Eccremidium whiteleggei*, *Lophidion strictus*, *Pleuridium acuminatum*, *Pleuridium alternifolium*, *Pleuridium holdridgei*, *Pleuridium mexicanum*, *Pleuridium ravenelii*, *Pleuridium subulatum*, *Saelania glaucescens*, *Trichodon borealis*, *Trichodon cylindricus* or *Trichodon cylindricus* var. *oblongus*, Elaeagnaceae such as the genus *Elaeagnus*, for example the genus and species *Olea europaea* [olive], Ericaceae such as the genus *Kalmia*, for example the genera and species *Kalmia latifolia*, *Kalmia angustifolia*, *Kalmia microphylla*, *Kalmia polifolia*, *Kalmia occidentalis*, *Cistus chamaerhodendros* or *Kalmia lucida* [mountain laurel], Euphorbiaceae such as the genera *Manihot*, *Janipha*, *Jatropha*, *Ricinus*, for example the genera and species *Manihot utilissima*, *Janipha manihot*, *Jatropha manihot*, *Manihot aipil*, *Manihot dulcis*, *Manihot manihot*, *Manihot melanobasis*, *Manihot esculenta* [manihot] or *Ricinus communis* [castor-oil plant], Fabaceae such as the genera *Pisum*, *Albizia*, *Cathormion*, *Feuillea*, *Inga*, *Pithecolobium*, *Acacia*, *Mimosa*, *Medicajo*, *Glycine*, *Dolichos*, *Phaseolus*, *Soja*, for example the genera and species *Pisum sativum*, *Pisum arvense*, *Pisum humile* [pea], *Albizia berteriana*, *Albizia julibrissin*, *Albizia lebbeck*, *Acacia berteriana*, *Acacia littoralis*, *Albizia berteriana*, *Albizzia berteriana*, *Cathormion berteriana*, *Feuillea berteriana*, *Inga fragrans*, *Pithecellobium berterianum*, *Pithecellobium fragrans*, *Pithecolobium berterianum*, *Pseudalbizzia berteriana*, *Acacia julibrissin*, *Acacia nemu*, *Albizia nemu*, *Feuilleea julibrissin*, *Mimosa julibrissin*, *Mimosa speciosa*, *Sericanrda julibrissin*, *Acacia lebbeck*, *Acacia macrophylla*, *Albizia lebbek*, *Feuilleea lebbeck*, *Mimosa lebbeck*, *Mimosa speciosa* [silk tree], *Medicago sativa*, *Medicago falcata*, *Medicago varia* [alfalfa], *Glycine max Dolichos soja*, *Glycine gracilis*, *Glycine hispida*, *Phaseolus max*, *Soja hispida* or *Soja* max [soybean], Funariaceae such as the genera *Aphanorrhegma*, *Entosthodon*, *Funaria*, *Physcomitrella*, *Physcomitrium*, for example the genera and species *Aphanorrhegma serratum*, *Entosthodon attenuatus*, *Entosthodon bolanderi*, *Entosthodon bonplandii*, *Entosthodon californicus*, *Entosthodon drummondii*, *Entosthodon jamesonii*, *Entosthodon leibergii*, *Entosthodon neoscoticus*, *Entosthodon rubrisetus*, *Entosthodon spathulifolius*, *Entosthodon tucsoni*, *Funaria americana*, *Funaria bolanderi*, *Funaria calcarea*, *Funaria californica*, *Funaria calvescens*, *Funaria convoluta*, *Funaria flavicans*, *Funaria groutiana*, *Funaria hygrometrica*, *Funaria hygrometrica* var. *arctica*, *Funaria hygrometrica* var. *calvescens*, *Funaria hygrometrica* var. *convoluta*, *Funaria hygrometrica* var. *muralis*, *Funaria hygrometrica* var. *utahensis*, *Funaria microstoma*, *Funaria microstoma* var. *obtusifolia*, *Funaria muhlenbergii*, *Funaria orcuttii*, *Funaria plano-convexa*, *Funaria polaris*, *Funaria ravenelii*, *Funaria rubriseta*, *Funaria serrata*, *Funaria sonorae*, *Funaria sublimbatus*, *Funaria tucsoni*, *Physcomitrella californica*, *Physcomitrella patens*, *Physcomitrella readeri*, *Physco-imitrium australe*, *Physcomitrium californicum*, *Physcomitrium collenchymatum*, *Physcomitrium coloradense*, *Physcomitrium cupuliferum*, *Physcomitrium drummondii*, *Physcomitrium eurystomum*, *Physcomitrium flexifolium*, *Physcomitrium hookeri*, *Physcomitrium hookeri* var. *serratum*, *Physcomitrium immersum*, *Physcomitrium kellermanii*, *Physcomitrium megalocarpum*, *Physcomitrium pyriforme*, *Physcomitrium pyriforme* var. *serratum*, *Physcomitrium rufipes*, *Physcomitrium sandbergii*, *Physcomitrium subsphaericum*, *Physcomitrium washingtoniense*, Geraniaceae, such as the genera *Pelargonium*, *Cocos*, *Oleum*, for example the genera and species *Cocos nucifera*, *Pelargonium grossularioides* or *Oleum cocois* [coconut], Gramineae, such as the genus *Saccharum*, for example the genus and species *Saccharum officinarum*, Juglandaceae, such as the genera *Juglans*, *Wallia*, for example the genera and species *Juglans regia*, *Juglans ailanthifolia*, *Juglans sieboldiana*, *Juglans cinerea*, *Wallia cinerea*, *Juglans bixbyi*, *Juglans californica*, *Juglans hindsii*, *Juglans intermedia*, *Juglans jamaicensis*, *Juglans major*, *Juglans microcarpa*, *Juglans nigra* or *Wallia* nigra [walnut], Lauraceae, such as the genera *Persea*, *Laurus*, for example the genera and species *Laurus nobilis* [bay], *Persea americana*, *Persea gratissima* or *Persea persea* [avocado], Leguminosae, such as the genus *Arachis*, for example the genus and species *Arachis hypogaea* [peanut], Linaceae, such as the genera *Linum*, *Adenolinum*, for example the genera and species *Linum usitatissimum*, *Linum humile*, *Linum austriacum*, *Linum bienne*, *Linum angustifolium*, *Linum catharticum*, *Linum flavum*, *Linum grandiflorum*, *Adenolinum grandiflorum*, *Linum lewisii*, *Linum narbonense*, *Linum perenne*, *Linum perenne* var. *lewisii*, *Linum pratense* or *Linum trigynum* [linseed], Lythrarieae, such as the genus *Punica*, for example the genus and species *Punica granatum* [pomegranate], Malvaceae, such as the genus *Gossypium*, for example the genera and species *Gossypium hirsutum*, *Gossypium arboreum*, *Gossypium barbadense*, *Gossypium herbaceum* or *Gossypium thurberi* [cotton], Marchantiaceae, such as the genus *Marchantia*, for example the genera and species *Marchantia berteroana*, *Marchantia foliacea*, *Marchantia macropora*, Musaceae, such as the genus *Musa*, for example the genera and species *Musa nana*, *Musa acuminata*, *Musa paradisiaca*, *Musa* spp. [banana], Onagraceae, such as the genera *Camissonia*, *Oenothera*, for example the genera and species *Oenothera biennis* or *Camissonia brevipes* [evening primrose], Palmae, such as the genus *Elacis*, for example the genus and species *Elaeis guineensis* [oil palm], Papaveraceae, such as the genus *Papaver*, for example the genera and species *Papaver orientale*, *Papaver rhoeas*, *Papaver dubium* [poppy], Pedaliaceae, such as the genus *Sesamum*, for example the genus and species *Sesamum indicum* [sesame], Piperaceae, such as the genera *Piper*, *Artanthe*, *Peperomia*, *Steffensia*, for example the genera and species *Piper aduncum*, *Piper amalago*, *Piper angustifolium*, *Piper auritum*, *Piper betel*, *Piper cubeba*, *Piper longum*, *Piper nigrum*, *Piper retrofractum*, *Artanthe adunca*, *Artanthe elongata*, *Peperomia elon-* gata, *Piper elongatum, Steffensia elongata* [cayenne pepper], Poaceae, such as the genera *Hordeum, Secale, Avena, Sorghum, Andropogon, Holcus, Panicum, Oryza, Zea* (maize), *Triticum*, for example the genera and species *Hordeum vulgare, Hordeum jubatum, Hordeum murinum, Hordeum secalinum, Hordeum distichon, Hordeum aegiceras, Hordeum hexastichon, Hordeum hexastichum, Hordeum irregulare, Hordeum sativum, Hordeum secalinum* [barley], *Secale cereale* [rye], *Avena sativa, Avena fatua, Avena byzantina, Avena fatua* var. *sativa, Avena hybrida* [oats], *Sorghum bicolor, Sorghum halepense, Sorghum saccharatum, Sorghum vulgare, Andropogon drummondii, Holcus bicolor, Holcus sorghum, Sorghum aethiopicum, Sorghum arundinaceum, Sorghum caffrorum, Sorghum cernuum, Sorghum dochna, Sorghum drummondii, Sorghum durra, Sorghum guineense, Sorghum lanceolatum, Sorghum nervosum, Sorghum saccharatum, Sorghum subglabrescens, Sorghum verticilliflorum, Sorghum vulgare, Holcus halepensis, Sorghum miliaceum, Panicum militaceum* [millet], *Oryza sativa, Oryza latifolia* [rice], *Zea mays* [maize], *Triticum aestivum, Triticum durum, Triticum turgidum, Triticum hybernum, Triticum macha, Triticum sativum* or *Triticum vulgare* [wheat], Porphyridiaceae, such as the genera *Chroothece, Flintiella, Petrovanella, Porphyridium, Rhodella, Rhodosorus, Vanhoeffenia*, for example the genus and species *Porphyridium cruentum*, Proteaceae, such as the genus *Macadamia*, for example the genus and species *Macadamia intergrifolia* [macadamia], Prasinophyceae such as the genera *Nephroselmis, Prasinococcus, Scherffelia, Tetraselmis, Mantoniella, Ostreococcus*, for example the genera and species *Nephroselmis olivacea, Prasinococcus capsulatus, Scherffelia dubia, Tetraselmis chui, Tetraselmis suecica, Mantoniella squamata, Ostreococcus tauri*, Rubiaceae such as the genus *Cofea*, for example the genera and species *Cofea* spp., *Coffea arabica, Coffea canephora* or *Coffea liberica* [coffee], Scrophulariaceae such as the genus *Verbascum*, for example the genera and species *Verbascum blattaria, Verbascum chaixii, Verbascum densiflorum, Verbascum lagurus, Verbascum longifolium, Verbascum lychnitis, Verbascum nigrum, Verbascum olympicum, Verbascum phlomoides, Verbascum phoenicum, Verbascum pulverulentum* or *Verbascum thapsus* [mullein], Solanaceae such as the genera *Capsicum, Nicotiana, Solanum, Lycopersicon*, for example the genera and species *Capsicum annuum, Capsicum annuum* var. *glabriusculum, Capsicum frutescens* [pepper], *Capsicum annuum* [paprika], *Nicotiana tabacum, Nicotiana alata, Nicotiana attenuata, Nicotiana glauca, Nicotiana langsdorffii, Nicotiana obtusifolia, Nicotiana quadrivalvis, Nicotiana repanda, Nicotiana rustica, Nicotiana sylvestris* [tobacco], *Solanum tuberosum* [potato], *Solanum melongena* [eggplant], *Lycopersicon esculentum, Lycopersicon lycopersicum, Lycopersicon pyriforme, Solanum integrifolium* or *Solanum lycopersicum* [tomato], Sterculiaceae, such as the genus *Theobroma*, for example the genus and species *Theobroma cacao* [cacao] or Theaceae, such as the genus *Camellia*, for example the genus and species *Camellia sinensis* [tea]. In particular preferred plants to be used as transgenic plants in accordance with the present invention are oil fruit crops which comprise large amounts of lipid compounds, such as peanut, oilseed rape, canola, sunflower, safflower, poppy, mustard, hemp, castor-oil plant, olive, sesame, *Calendula, Punica*, evening primrose, mullein, thistle, wild roses, hazelnut, almond, macadamia, avocado, bay, pumpkin/squash, linseed, soybean, pistachios, borage, trees (oil palm, coconut, walnut) or crops such as maize, wheat, rye, oats, triticale, rice, barley, cotton, cassava, pepper, *Tagetes*, Solanaceae plants such as potato, tobacco, eggplant and tomato, *Vicia* species, pea, alfalfa or bushy plants (coffee, cacao, tea), *Salix* species, and perennial grasses and fodder crops.

Preferred plants according to the invention are oil crop plants such as peanut, oilseed rape, canola, sunflower, safflower, poppy, mustard, hemp, castor-oil plant, olive, *Calendula, Punica*, evening primrose, pumpkin/squash, linseed, soybean, borage, trees (oil palm, coconut). Especially preferred are sunflower, safflower, tobacco, mullein, sesame, cotton, pumpkin/squash, poppy, evening primrose, walnut, linseed, hemp, thistle or safflower. Very especially preferred plants are plants such as safflower, sunflower, poppy, evening primrose, walnut, linseed, or hemp, or most preferred, plants of family Brassicaceae.

Most preferably, the plant of the present invention is a plant found in the "Triangle of U", i.e. a plant of genus *Brassica*: *Brassica napus* (AA CC genome; n=19) is an amphidiploid plant of the *Brassica* genus but is thought to have resulted from hybridization of *Brassica rapa* (AA genome; n=10) and *Brassica oleracea* (CC genome; n=9). *Brassica juncea* (AA BB genome; n=18) is an amphidiploid plant of the *Brassica* genus that is generally thought to have resulted from the hybridization of *Brassica rapa* and *Brassica nigra* (BB genome; n=8). Under some growing conditions, *B. juncea* may have certain superior traits to *B. napus*. These superior traits may include higher yield, better drought and heat tolerance and better disease resistance. *Brassica carinata* (BB CC genome; n=17) is an amphidiploid plant of the *Brassica* genus but is thought to have resulted from hybridization of *Brassica nigra* and *Brassica oleracea*. Under some growing conditions, *B. carinata* may have superior traits to *B. napus*. Particularly, *B. carinata* allows for an increase in VLC-PUFA concentrations by at least 20% compared to *B. napus* when transformed with the same T-DNA.

The plant of the present invention preferably is a "Canola" plant. Canola is a genetic variation of rapeseed developed by Canadian plant breeders specifically for its oil and meal attributes, particularly its low level of saturated fat. Canola herein generally refers to plants of *Brassica* species that have less than 2% erucic acid (Delta 13-22:1) by weight in seed oil and less than 30 micromoles of glucosinolates per gram of oil-free meal. Typically, canola oil may include saturated fatty acids known as palmitic acid and stearic acid, a monounsaturated fatty acid known as oleic acid, and polyunsaturated fatty acids known as linoleic acid and linolenic acid. Canola oil may contain less than about 7% (w/w) total saturated fatty acids (mostly palmitic acid and stearic acid) and greater than 40% (w/w) oleic acid (as percentages of total fatty acids). Traditionally, canola crops include varieties of *Brassica napus* and *Brassica rapa*. Preferred plants of the present invention are spring canola (*Brassica napus* subsp. *oleifera* var. *annua*) and winter canola (*Brassica napus* subsp. *oleifera* var. *biennis*). Furthermore a canola quality *Brassica juncea* variety, which has oil and meal qualities similar to other canola types, has been added to the canola crop family (U.S. Pat. No. 6,303,849, to Potts et al., issued on Oct. 16, 2001; U.S. Pat. No. 7,423,198, to Yao et al.; Potts and Males, 1999; all of which are incorporated herein by reference). Likewise it is possible to establish canola quality *B. carinata* varieties by crossing canola quality variants of *Brassica napus* with *Brassica nigra* and appropriately selecting progeny thereof, optionally after further back-crossing with *B. carinata, B. napus* and/or *B. nigra*.

The invention also provides a plant or seed thereof of family Brassicaceae, preferably of genus *Brassica*, with a genotype that confers a heritable phenotype of seed oil VLC-PUFA content, obtainable or obtained from progeny lines prepared by a method comprising the steps of i) crossing a plant of family Brassicaceae, preferably of genus *Brassica*, most preferably of genus *Brassica napus, Brassica oleracea, Brassica nigra* or *Brassica carinata*, said plant comprising a combination of polynucleotides encoding for desaturases or elongases as set forth in the context of the method of the present invention, a construct or T-DNA of the present invention and/or part of such construct or T-DNA, with a parent plant of family Brassicaceae, preferably of genus *Brassica*, most preferably of genus *Brassica napus, Brassica oleracea, Brassica nigra* or *Brassica carinata*, said plant not comprising said T-DNA and/or part thereof, to yield a F1 hybrid, ii) selfing the F1 hybrid for at least one generation, and iii) identifying the progeny of step (ii) comprising the combination of polynucleotides, the construct, T-DNA of the present invention capable of producing seed comprising an increased tocopherol content as compared to a control plant. In an embodiment, an increased tocopherol content is a tocopherol content as disclosed elsewhere herein.

In an embodiment, the produced seed comprise VLC-PUFA such that the content of all VLC-PUFA downstream of 18:1n-9 is at least 40% (w/w) of the total seed fatty acid content at an oil content of 40% (w/w), or preferably the content of EPA is at least 8%, or at least 12% (w/w) and/or the content of DHA is at least 1% (w/w) of the total seed fatty acid content at an oil content of 40% (w/w).

In an embodiment, the produced seed comprise VLC-PUFA such that the content of EPA is at least 8%, or at least 12%. (w/w).

In an embodiment, the content of DHA is at least 1% (w/w) of the total seed fatty acid content.

This method allows for effectively incorporation of genetic material of other members of family Brassicaceae, preferably of genus *Brassica*, into the genome of a plant comprising the polynucleotides as set forth in the context of the method of the present invention, a T-DNA, or construct of the present invention. The method is particularly useful for combining the polynucleotides, the T-DNA and/or the construct with genetic material responsible for beneficial traits exhibited in other members of family Brassicaceae. Beneficial traits of other members of family Brassicaceae are exemplarily described herein, other beneficial traits or genes and/or regulatory elements involved in the manifestation of a beneficial trait may be described elsewhere.

The parent plant not comprising the said polynucleotides, the T-DNA or the construct of the present invention or part thereof preferably is an agronomically elite parent. In particular, the present invention teaches the transfer of heterologous material from a plant or seed of the present invention to a different genomic background, for example a different variety or species.

In particular, the invention teaches the transfer of the T-DNA or part thereof (the latter is particularly relevant for those plants of the present invention which comprise, in addition to a full T-DNA or construct of the present invention, also a part of a T-DNA or construct of the present invention, said part preferably comprising at least one expression cassette, the expression cassette preferably comprising a gene coding for a desaturase or elongase, preferably a delta-12-desaturase, delta-6-desaturase and/or omega-3-desaturase) into a species of genus *Brassica carinata*, or to introduce genetic material from *Brassica carinata* or *Brassica nigra* into the plants of the present invention comprising the T-DNA of the present invention and/or a part or two or more parts thereof. According to the invention, genes of *Brassica nigra* replacing their homolog found in *Brassica napus* or added in addition to the homolog found in *Brassica napus* are particularly helpful in further increasing the amount of VLC-PUFAs in plant seeds and oils thereof.

Also, the invention teaches novel plant varieties comprising the polynucleotides encoding for the desaturases or elongases as set forth in the context of the method of the present invention, the construct or T-DNA and/or part thereof of the present invention. Such varieties can, by selecting appropriate mating partners, be particularly adapted e.g. to selected climatic growth conditions, herbicide tolerance, stress resistance, fungal resistance, herbivore resistance, increased or reduced oil content or other beneficial features. It is particularly beneficial to provide plants of the present invention wherein the oil content thereof at harvest is lower than that of corresponding wild type plants of the same variety, such as to increase the total tocopherol content (and to improve VLC-PUFA amounts) in the oil of said plants of the present invention and/or tocopherol concentration (and VLC-PUFA concentrations) in said oil.

Also, the invention provides a method for creating a plant with a genotype that confers a heritable phenotype of tocopherol content (in particular an increased content in the seed oil), obtainable or obtained from progeny lines prepared by a method comprising the steps of i) crossing a transgenic plant of the invention with a parent plant not comprising the polynucleotides encoding for the desaturases or elongases as set forth in the context of the method of the present invention, the construct or T-DNA of the present invention or part thereof, said parent plant being of family Brassicaceae, preferably of genus *Brassica*, most preferably of genus *Brassica napus, Brassica oleracea, Brassica nigra* or *Brassica carinata*, to yield a F1 hybrid, ii) selfing the F1 hybrid for at least one generation, and iii) identifying the progeny of step (ii) comprising the polynucleotides, construct or T-DNA capable of producing seed comprising an increased tocopherol content as compared to seed of a control plant.

In an embodiment, said seed may comprise VLC-PUFA such that the content of all VLC-PUFA downstream of 18:1n-9 is at least 40% (w/w) of the total seed fatty acid content at an oil content of 40% (w/w), or preferably the content of EPA is at least 8% (w/w) and/or the content of DHA is at least 1% (w/w) of the total seed fatty acid content at an oil content of 30% (w/w), preferably at an oil content of 35% (w/w), and more preferably at an oil content of 40% (w/w).

The method allows the creation of novel variants and transgenic species of plants of the present invention, and the seeds thereof. Such plants and seeds exhibit the aforementioned benefits of the present invention. Preferably, the content of EPA is at least 10% by weight, even more preferably at least 13% (w/w), of the total lipid content of the oil. Also preferably, the content of DHA is at least 1.5% by weight, even more preferably at least 2% (w/w), of the total lipid content of the oil. The present invention for the first time allows for the achievement of such high levels of tocopherol and VLC-PUFA in seed reliably under agronomic conditions, i.e. representative for the real yield obtained from seeds of a commercial field of at least 1 ha planted with plants of the present invention, wherein the plants have a defined copy number of genes for implementing the pathway for production of EPA and/or DHA in said plants, and the copy number being low, i.e. single-copy or partial double copy.

A plant of the present invention also includes plants obtainable or obtained by backcrossing (cross into the non-transgenic, isogenic parent line), and by crossing with other germplasms of the Triangle of U. Accordingly, the invention provides a method for creating a plant with a genotype that confers a heritable phenotype of an increased seed oil tocopherol content, obtainable or obtained from a progeny line prepared by a method comprising the steps of i) crossing a transgenic plant of the invention (also called "non-recurring parent") with a parent plant not expressing a gene comprised in the polynucleotides, T-DNA or contruct of the present invention, said parent plant being of family Brassicaceae, preferably of genus *Brassica*, most preferably of genus *Brassica napus, Brassica oleracea, Brassica nigra* or *Brassica carinata*, to yield a hybrid progeny, ii) crossing the hybrid progeny again with the parent to obtain another hybrid progeny, iii) optionally repeating step ii) and iv) selecting a hybrid progeny comprising the polynucleotides encoding desaturases or elongases as set forth in the contact of the method of present invention, the T-DNA, or the construct of the present invention.

Backcrossing methods, e.g. as described above, can be used with the present invention to improve or introduce a characteristic into the plant line comprising the polynucleotides, construct or T-DNA of the present invention. Such hybrid progeny is selected in step iv) which suffices predetermined parameters. The backcrossing method of the present invention thereby beneficially facilitates a modification of the genetic material of the recurrent parent with the desired gene, or preferably the polynucleotides, construct, or T-DNA of the present invention, from the non-recurrent parent, while retaining essentially all of the rest of the desired genetic material of the recurrent parent, and therefore the desired physiological and morphological, constitution of the parent line. The selected hybrid progeny is then preferably multiplied and constitutes a line as described herein. Selection of useful progeny for repetition of step ii) can be further facilitated by the use of genomic markers. For example, such progeny is selected for the repetition of step ii) which comprises, compared to other progeny obtained in the previous crossing step, most markers also found in the parent and/or least markers also found in the non-recurring parent except the desired polynucleotides, construct, or T-DNA of the present invention or part of the T-DNA or construct thereof.

Preferably, a hybrid progeny is selected which comprises the polynucleotides, construct or T-DNA of the present invention, and even more preferably also comprises at least one further expression cassette from the non-recurring parent of the present invention, e.g. by incorporation of an additional part of the construct or T-DNA of the present invention into the hybrid plant genetic material.

Further preferably a hybrid progeny is obtained wherein essentially all of the desired morphological and physiological characteristics of the parent are recovered in the converted plant, in addition to genetic material from the non-recurrent parent as determined at the 5% significance level when grown under the same environmental conditions.

Further preferably, a hybrid progeny is selected which produces seed comprising an increased tocopherol content as compared to a control, in particular in the oil of seeds. Also preferably, the seed comprise VLC-PUFA such that the content of all VLC-PUFA downstream of 18:1n-9 is at least 40% (w/w) of the total seed fatty acid content at an oil content of 40% (w/w), or preferably the content of EPA is at least 8% (w/w) and/or the content of DHA is at least 1% (w/w) of the total seed fatty acid content at an oil content of 30% (w/w), preferably at an oil content of 35% (w/w), and more preferably at an oil content of 40% (w/w).

It is to be understood that such seed VLC-PUFA or tocopherol content is to be measured not from a single seed or from the seeds of an individual plant, but refers to the numeric average of seed VLC-PUFA content of at least 100 plants, even more preferably of at least 200 plants, even more preferably of at least 200 plants half of which have been grown in field trials in different years.

The choice of the particular non-recurrent parent will depend on the purpose of the backcross. One of the major purposes is to add some commercially desirable, agronomically important trait to the line.

The term "line" refers to a group of plants that displays very little overall variation among individuals sharing that designation. A "line" generally refers to a group of plants that display little or no genetic variation between individuals for at least one trait. A "DH (doubled haploid) line," as used in this application refers to a group of plants generated by culturing a haploid tissue and then doubling the chromosome content without accompanying cell division, to yield a plant with the diploid number of chromosomes where each chromosome pair is comprised of two duplicated chromosomes. Therefore, a DH line normally displays little or no genetic variation between individuals for traits. Lines comprising one or more genes originally comprised in a T-DNA of the present invention in the non-recurring parent also constitute plants of the present invention.

The invention is also concerned with a method of plant oil and/or tocopherol production (in particular for tocopherol production), comprising the steps of i) growing a plant of the present invention such as to obtain oil-containing seeds thereof, ii) harvesting said seeds, and iii) extracting oil from said seeds harvested in step ii).

Preferably the oil has an increased tocopherol content, in particular as compared to the oil extracted from seeds of a control plant. Preferred increased tocopherol contents are disclosed elsewhere herein.

The extraction step under iii) is preferably carried out under conditions which maintain the tocopherol content of the oil. Conditions which maintain the tocopherol content of the oil in the context of the present invention shall be conditions which do not reduce the tocopherol content. Such conditions are well known in the art and are e.g. described in Willner et al. Einfluß der Prozeßparameter auf die Tocopherolbilanz bei der Gewinnung von pflanzlichen Ölen. Lipid/Fett, Volume 99, Issue 4, pages 138-147, 1997 which herewith is incorporated by reference in its entirety.

In addition, the oil may have a DHA content of at least 1% by weight based on the total lipid content and/or an EPA content of at least 8% by weight based on the total lipid content.

In a further step, the method may comprise the step iv) of isolating tocopherol from the oil extracted in step iii).

In an embodiment, the term "isolating tocopherol" means "enriching tocopherol".

How to isolate tocopherol from oil is well known in the art and e.g. described in "Commercial Extraction of Vitamin E from Food Sources" in The Encyclopedia of Vitamin E, Preedy, V. R. and Watson R. R. (eds.), CABI Publishers, Oxford, U.K., pp. 140-152 and in U.S. Pat. No. 5,627,289. Both documents are incorporated herein in their entirety.

For example, tocopherols can be isolated from by various methods such as esterification of the free fatty acids in the oil, by saponification which allows for removal of fatty components from the oil, distillation, by chromatographic methods, by enzymatic methods (by using lipase) etc. These and further methods are described in the chapter of "The Encyclopedia of Vitamin E" referred to in the previous paragraph in detail.

In an embodiment, the isolation comprises esterifying free fatty acids in said oil with methanol; transesterifying triglycerides in said oil by alkali-catalyzed transesterification with methanol; acidifying and then washing the oil resulting from said transesterification; and removing by distillation fatty acid methyl esters from the oil resulting from said acidifying and washing. In an embodiment, steam distillates of the oil are used as the oil.

In an embodiment, an inorganic acid such as hydrochloric acid is used for the acidifying.

In an embodiment, 1 to 1.5 parts by volume of said mixture is esterified using 1 part by volume of methanol.

In an embodiment, the free fatty acids are esterified at a temperature of 60 to 100° C. (in particular at temperature of 65 to 70° C.). Preferably, the fatty acids are esterified the presence of a strongly acidic ion exchanger.

Preferably, the oil comprises EPA, DHA, and/or DPA n-3 in concentrations described herein below.

Also preferably, the content of EPA is at least 8% by weight, even more preferably at least 10% (w/w), of the total lipid content of the oil. Preferably, the content of DHA is at least 1% by weight, even more preferably at least 1.5% (w/w), of the total lipid content of the oil. As described herein, the plant of the present invention comprises, for the purposes of such method of plant oil production, preferably comprises the polynucleotides, the construct, or the T-DNA of the present invention and optionally also one or more additional parts of the T-DNA or of the construct, wherein the part or parts, respectively, comprise at least one expression cassette of the T-DNA of the present invention.

The present invention also relates to oil comprising an increased tocopherol content. Preferably, said oil is obtainable by the aforementioned methods, or produced by the plant of the present invention. Preferably, said oil also comprises an increased content of VLC-PUFA (The term "high content" and "increased content" are used interchangeably herein). For example, the oil can comprise EPA, DHA, and/or DPA n-3 in concentrations described herein below.

The term "oil" refers to a fatty acid mixture comprising unsaturated and/or saturated fatty acids which are esterified to triglycerides. Preferably, the triglycerides in the oil of the invention comprise PUFA or VLC-PUFA moieties as referred to above. The amount of esterified PUFA and/or VLC-PUFA is, preferably, approximately 30%, a content of 50% is more preferred, a content of 60%, 70%, 80% or more is even more preferred. The oil may further comprise free fatty acids, preferably, the PUFA and VLC-PUFA referred to above. For the analysis, the fatty acid content can be, e.g., determined by GC analysis after converting the fatty acids into the methyl esters by transesterification. The content of the various fatty acids in the oil or fat can vary, in particular depending on the source. The oil, however, shall have a non-naturally occurring composition with respect to the PUFA and/or VLC-PUFA composition and content. It is known that most of the fatty acids in plant oil are esterified in triacylglcerides. Accordingly, in the oil of the invention, the PUFAs and VLC-PUFAs, preferably, also occur in esterified form in the triacylglcerides. It will be understood that such a unique oil composition and the unique esterification pattern of PUFA and VLC-PUFA in the triglycerides of the oil shall only be obtainable by applying the methods of the present invention specified above. Moreover, the oil of the invention may comprise other molecular species as well. Specifically, it may comprise minor amounts of the polynucleotide or vector of the invention. Such low amounts, however, can be detected only by highly sensitive techniques such as PCR.

As described above, these oils, lipids or fatty acids compositions, preferably, comprise (by weight) 6 to 15% of palmitic acid, 1 to 6% of stearic acid, 7-85% of oleic acid, 0.5 to 8% of vaccenic acid, 0.1 to 1% of archaic acid, 7 to 25% of saturated fatty acids, 8 to 85% of monounsaturated fatty acids and 60 to 85% of polyunsaturated fatty acids, in each case based on 100% and on the total fatty acid content of the organisms (preferably by weight). Preferred VLC-PUFAs present in the fatty acid esters or fatty acid mixtures is, preferably, 1% to 20% DHA, or 5,5% to 20% of DHA and/or 9,5% to 30% EPA based on the total fatty acid content (preferably by weight).

The oils, lipids or fatty acids according to the invention, preferably, comprise at least 1%, 2%, 3%, 4% 5.5%, 6%, 7% or 7,5%, more preferably, at least 8%, 9%, 10%, 11% or 12%, and most preferably at least 13%, 14%, 15%, 16%. 17%, 18%, 19% or 20% of DHA, and/or at least 9.5%, 10%, 11% or 12%, more preferably, at least 13%, 14%, 14.5%, 15% or 16%, and most preferably at least 17%, 18%, 19%, 20%. 21%, 22%, 23%, 24%, 25%, 26%, 27%, 28%, 29% or 30% of EPA (preferably by weight) based on the total fatty acid content of the production host cell, organism, advantageously of a plant, especially of an oil crop such as soybean, oilseed rape, coconut, oil palm, safflower, flax, hemp, castor-oil plant, *Calendula*, peanut, cacao bean, sunflower or the abovementioned other monocotyledonous or dicotyledonous oil crops.

The seeds of the present invention shall comprise the oil or lipid of the present invention. Preferably, the oil or lipid is extracted, obtained, obtainable or produced from a plant, more preferably from seeds of a plant or plants (in particular a plant or plants of the present invention).

The oil or lipid thus can be obtained by the methods of the present invention. In particular, the plant oil or plant lipid is an extracted plant oil or lipid. Also preferably, said oil or lipid is extracted, obtained, obtainable or produced from a plant, more preferably from batches of seeds or bulked seeds of a plant or plants (in particular a plant or plants of the present invention).

Preferably, the term "extracted" in connection with an oil or lipid refers to an oil or lipid that has been extracted from a plant, in particular from seeds of a plant or plants. More preferably, the term "extracted" in connection with an oil or lipid refers to an oil or lipid that has been extracted from a plant, in particular from batch of seeds or bulked seeds of a plant or plants. Such oil or lipid can be a crude composition. However, it may be also a purified oil or lipid in which e.g. the water has been removed. In an embodiment, the oil or lipid is not blended with fatty acids from other sources.

The oil or lipid of the present invention may be also an oil or lipid in a seed of plant. Preferably, said plant is a transgenic plant. More preferably, said plant is a plant of the present invention. In a particular preferred embodiment, the plant is a *Brassica* plant.

The oil or lipid of the present invention shall comprise fatty acids. In particular, the oil or lipid shall comprise fatty acids in esterified form. Thus, the fatty acids shall be esterified. Preferably, the oil or lipid of the present comprises one or more of following fatty acids (in esterified form): Eicosapentaenoic acid (Timnodonic acid, EPA, 20:5n-3), Clupanodonic acid (DPA n-3), and DHA ((Z,Z,Z,Z,Z,Z)-4, 7,10,13,16,19-Docosahexaenoic acid). In an embodiment, the oil or lipid comprises EPA and DHA. Further, it is envisaged that the oil or lipid comprises EPA, DHA, and DPA n-3.

Preferred contents of the aforementioned fatty acids in the total fatty acid content of the lipid or oil of the present invention is further described in the following. In the following, ranges are given for the contents. The contents (levels) of fatty acids given herein are expressed as percentage (weight of a particular fatty acid) of the total weight of all fatty acids (present in the oil or lipid). The contents are thus, preferably given as weight percentage (% w/w). The contents given below are considered as high contents.

Preferably, the fatty acids are present in esterified form. Thus, the fatty acids shall be esterified fatty acids.

As set forth above, the oil or lipid may comprise EPA (20:5n-3). Preferably, the content of Eicosapentaenoic acid (Timnodonic acid, EPA, 20:5n-3) is between 0.1% and 20%, more preferably between 2% and 15%, most preferably between 5% and 10% of the total fatty acid content. Further, it is envisaged that the content of EPA is between 5% and 15% of the total fatty acid content.

As set forth above, the oil or lipid may comprise Clupanodonic acid (DPA n-3). Preferably, the content of Clupanodonic acid (DPA n-3) is between 0.1% and 10%, more preferably between 1% and 6%, most preferably between 2% and 4% of the total fatty acid content. In addition, the content of DPA n-3 may be at least 2% of the total fatty acids.

As set forth above, the oil or lipid may comprise DHA. Preferably, the content of DHA is between 1% and 10%, more preferably between 1% and 4%, most preferably between 1% and 2% of the total fatty acid content. Further, it is envisaged that the content of DHA is between 1% and 3% of the total fatty acid content.

A further embodiment according to the invention is the use of the oil, lipid, fatty acids and/or the fatty acid composition in feedstuffs, foodstuffs, dietary supplies, cosmetics or pharmaceutical compositions as set forth in detail below. The oils, lipids, fatty acids or fatty acid mixtures according to the invention can be used for mixing with other oils, lipids, fatty acids or fatty acid mixtures of animal origin such as, for example, fish oils.

The term "composition" refers to any composition formulated in solid, liquid or gaseous form. Said composition comprises the compound of the invention optionally together with suitable auxiliary compounds such as diluents or carriers or further ingredients. In this context, it is distinguished for the present invention between auxiliary compounds, i.e. compounds which do not contribute to the effects elicited by the compounds of the present invention upon application of the composition for its desired purpose, and further ingredients, i.e. compounds which contribute a further effect or modulate the effect of the compounds of the present invention. Suitable diluents and/or carriers depend on the purpose for which the composition is to be used and the other ingredients. The person skilled in the art can determine such suitable diluents and/or carriers without further ado. Examples of suitable carriers and/or diluents are well known in the art and include saline solutions such as buffers, water, emulsions, such as oil/water emulsions, various types of wetting agents, etc.

In a more preferred embodiment of the oil-, fatty acid or lipid-containing composition, the said composition is further formulated as a pharmaceutical composition, a cosmetic composition, a foodstuff, a feedstuff, preferably, fish feed or a dietary supply.

The term "pharmaceutical composition" as used herein comprises the compounds of the present invention and optionally one or more pharmaceutically acceptable carrier. The compounds of the present invention can be formulated as pharmaceutically acceptable salts. Acceptable salts comprise acetate, methylester, Hel, sulfate, chloride and the like. The pharmaceutical compositions are, preferably, administered topically or systemically. Suitable routes of administration conventionally used for drug administration are oral, intravenous, or parenteral administration as well as inhalation. However, depending on the nature and mode of action of a compound, the pharmaceutical compositions may be administered by other routes as well. For example, polynucleotide compounds may be administered in a gene therapy approach by using viral vectors or viruses or liposomes.

Moreover, the compounds can be administered in combination with other drugs either in a common pharmaceutical composition or as separated pharmaceutical compositions wherein said separated pharmaceutical compositions may be provided in form of a kit of parts. The compounds are, preferably, administered in conventional dosage forms prepared by combining the drugs with standard pharmaceutical carriers according to conventional procedures. These procedures may involve mixing, granulating and compressing or dissolving the ingredients as appropriate to the desired preparation. It will be appreciated that the form and character of the pharmaceutically acceptable carrier or diluent is dictated by the amount of active ingredient with which it is to be combined, the route of administration and other well-known variables. The carrier(s) must be acceptable in the sense of being compatible with the other ingredients of the formulation and being not deleterious to the recipient thereof. The pharmaceutical carrier employed may be, for example, a solid, a gel or a liquid. Exemplary of solid carriers are lactose, terra alba, sucrose, talc, gelatin, agar, pectin, acacia, magnesium stearate, stearic acid and the like. Exemplary of liquid carriers are phosphate buffered saline solution, syrup, oil such as peanut oil and olive oil, water, emulsions, various types of wetting agents, sterile solutions and the like. Similarly, the carrier or diluent may include time delay material well known to the art, such as glyceryl mono-stearate or glyceryl distearate alone or with a wax. Said suitable carriers comprise those mentioned above and others well known in the art, see, e.g., Remington's Pharmaceutical Sciences, Mack Publishing Company, Easton, Pa. The diluent(s) is/are selected so as not to affect the biological activity of the combination. Examples of such diluents are distilled water, physiological saline, Ringer's solutions, dextrose solution, and Hank's solution. In addition, the pharmaceutical composition or formulation may also include other carriers, adjuvants, or nontoxic, nontherapeutic, nonimmunogenic stabilizers and the like. A therapeutically effective dose refers to an amount of the compounds to be used in a pharmaceutical composition of the present invention which prevents, ameliorates or treats the symptoms accompanying a disease or condition referred to in this specification.

The term "cosmetic composition" relates to a composition which can be formulated as described for a pharmaceutical composition above. For a cosmetic composition, likewise, it is envisaged that the compounds of the present invention are also, preferably, used in substantially pure form. Impurities, however, may be less critical than for a pharmaceutical composition. Cosmetic compositions are, preferably, to be applied topically.

Preferred cosmetic compositions comprising the compounds of the present invention can be formulated as a hair tonic, a hair restorer composition, a shampoo, a powder, a jelly, a hair rinse, an ointment, a hair lotion, a paste, a hair cream, a hair spray and/or a hair aerosol.

Seeds of three events described in detail in the examples section below have been deposited at ATCC under the provisions of the Budapest treaty on the International Recognition of the Deposit of Microorganisms for the Purposes of Patent Procedure, i.e. seeds of event "LBFLFK"=ATCC Designation "PTA-121703", seeds of event "LBFDHG"=ATCC designation "PTA-121704", and seeds of the event "LBFDAU"=ATCC Designation "PTA-122340". Applicants have no authority to waive any restrictions imposed by law on the transfer of biological material or its transportation in commerce. Applicants do not waive any infringement of their rights granted under this patent or rights applicable to the deposited events under the Plant Variety Protection Act (7 USC sec. 2321, et seq.), Unauthorized seed multiplication prohibited. This seed may be regulated according to national law. The deposition of seeds was made only for convenience of the person skilled in the art and does not constitute or imply any confession, admission, declaration or assertion that deposited seed are required to fully describe the invention, to fully enable the invention or for carrying out the invention or any part or aspect thereof. Also, the deposition of seeds does not constitute or imply any recommendation to limit the application of any method of the present invention to the application of such seed or any material comprised in such seed, e.g. nucleic acids, proteins or any fragment of such nucleic acid or protein.

The deposited seeds are derived from plants that were transformed with the T-DNA vector having a sequence as shown in SEQ ID NO: 3.

The invention is further described by means of accompanying examples, which, however, are not intended to limit the scope of the invention described herein.

EXAMPLES

Example 1: Materials and Methods

A. General Cloning Methods

Cloning methods as e.g. use of restriction endonucleases to cut double stranded DNA at specific sites, agarose gel electrophoreses, purification of DNA fragments, transfer of nucleic acids onto nitrocellulose and nylon membranes, joining of DNA-fragments, transformation of *E. coli* cells and culture of bacteria were performed as described in Sambrook et al. (1989) (Cold Spring Harbor Laboratory Press: ISBN 0-87965-309-6). Polymerase chain reaction was performed using Phusion™ High-Fidelity DNA Polymerase (NEB, Frankfurt, Germany) according to the manufacturer's instructions. In general, primers used in PCR were designed such that at least 20 nucleotides of the 3' end of the primer anneal perfectly with the template to amplify. Restriction sites were added by attaching the corresponding nucleotides of the recognition sites to the 5' end of the primer. Fusion PCR, for example described by K. Heckman and L. R. Pease, Nature Protocols (2207) 2, 924-932 was used as an alternative method to join two fragments of interest, e.g. a promoter to a gene or a gene to a terminator. Gene Synthesis, as for example described by Czar et al. (Trends in Biotechnology, 2009, 27(2): 63-72), was performed by Life Technologies using their Geneart® service. The Geneart® technology, described in WO2013049227 allows production of genetic elements of a few basepair (bp) in length, and was used in this invention to produce entire plasmids of about 60,000 bp. Chemical synthesis of nucleotides to polynucleotides was employed for short DNA fragments, which were then combined in a sequential, modular fashion to fragments of increasing size using a combination of conventional cloning techniques as described in WO2013049227.

B. Different Types of Plant Transformation Plasmids Suitable to Transfer of Multiple Expression Cassettes Encoding Multiple Proteins into the Plant Genome.

For agrobacteria based plant transformation, DNA constructs preferably meet a number of criteria: (1) The construct carries a number of genetic elements that are intended to be inserted into the plant genome on a so called Transfer DNA (T-DNA) between a 'T-DNA Left Border' (LB) and 'T-DNA Right Border' (2) The construct replicates in *E. coli*, because most cloning steps require DNA multiplication steps in *E. coli*. (3) The construct replicates in *Agrobacterium* (e.g. *A. tumefaciens* or *A. rhizogenes*), because the plant transformation methods rely on using *Agrobacterium* to insert the genetic elements of interest into the plant genome of a cell that was infected by *Agrobacterium*. (4) The construct contains supporting genetic elements that encode proteins which are required for infection of the plant cell, and for transfer and integration of desired genetic elements into the plant genome of an plant cell infected by the *Agrobacterium*, or the construct was used in combination with a second construct containing such supporting genetic elements that was present in the same *Agrobacterium* cell. (5) The constructs can contain selection markers to facilitate selection or identification of bacterial cells that contain the entire construct, and of a plant cell(s) that contains the desired genetic elements. An overview of available plasmids was given in Komori et al (2007).

C. Assembly of Genes Required for EPA and DHA Synthesis within BiBAC T-Plasmids Containing the F Factor/pRI Origin of Replication For synthesis of VLC-PUFA in *Brassica napus* seeds, the set of genes encoding the proteins of the metabolic VLC-PUFA pathway were combined with expression elements (promoter, terminators and introns) and transferred into a binary t-plasmid that was used for agrobacteria mediated transformation of plants. All expression cassettes have been combined onto a single binary T-plasmid. The advance of DNA synthesis allows numerous companies to offer services to use a combination of chemical synthesis and molecular biological techniques to synthesize de novo, without an initial template, polynucleotides up to the size of microbial genomes. Synthesis used in the construction of the plasmid described in this example was performed by Life Technologies using their Geneart® service. The Geneart® technology, described in WO2013049227 allows production of genetic elements of a few basepair (bp) length, and was used in this invention to produce the binary T-plasmid for plant transformation VC-LTM593-1qcz rc having a total size of ~61.000 bp. The structure of the plasmid VC-LTM593-1qcz rc is given in Table 1.

TABLE 1

Genetic Elements of plasmid VC-LTM593-1qcz rc. Listed are the names of the elements, the position in VC-LTM593-1qcz rc (nucleotide number, note: start position was larger than stop position for elements encoded by the complementary strand of VC-LTM593-1qcz rc), the function and source of the element. The T-DNA integrated into the plant genome during the transformation process was flanked by a right border (nucleotides 59895 to 148 of VC-LTM593-1qcz rc) and a left border (nucleotides 43830 to 43695 of VC-LTM593-1qcz rc). Elements outside of that region (=vector backbone) are required for cloning and stable maintenance in *E. coli* and/or agrobacteria. The sequence of this vector is shown in SEQ ID NO: 3. The locations (of the e.g. of promoters, genes, introns, terminators and separators) in SEQ ID NO: 3 are indicted in the second and third column.

| Genetic Elements of plasmid VC-LTM593-1qcz rc | From | To | Description, Function and Source of Element |
|---|---|---|---|
| p-VfUSP_684 bp[LLL894] | 329 | 1012 | Promoter from UNKNOWN SEED PROTEIN gene USP (accession: X56240) from *Vicia faba* |
| i-Atss 18_252[LJK36] | 1013 | 1264 | i-Atss18_252 bp functional intron region; intron with partial 5' UTR, *Arabidopsis thaliana*, Locus At1g01170, +37 to +288 bp (numbering relative to start of transcription) (+72 to +282 bp 5'UTR-Intron only) |
| c-d6Elo(Pp_GA2) | 1267 | 2139 | Delta-6 ELONGASE from *Physcomitrella patens* |
| t-CaMV35S | 2140 | 2355 | Terminator CaMV35S from 35S gene from Cauliflower mosaic virus |
| p-LuCnl(1064 bp) | 2448 | 3511 | Promoter from CONLININ gene from *Linum usitatissimum* |
| i-Atss 14_377 bp[LJK32] | 3512 | 3888 | i-Atss14_377 bp[LJK32] functional intron region; intron with partial 5'UTR, *Arabidopsis thaliana*, Locus At5g63190, +166 to +542 bp (numbering relative to start of transcription) (+201 to +542 bp 5'UTR-Intron only) |
| c-d5Des(Tc_GA2) | 3892 | 5211 | Delta-5 DESATURASE from *Thraustochytrium* sp. ATCC21685 |
| t-AgrOCS 192 bp[LED12] | 5212 | 5403 | Terminator from OCTOPINE SYNTHASE gene OCS from *Agrobacterium tumefaciens* |
| p-SBP | 5539 | 7337 | Promoter from a SUCROSE-BINDING PROTEIN-RELATED gene from *Vicia faba* |
| i-Atss2_455 bp[LJK20] | 7338 | 7792 | i-Atss2_455 bp functional intron region; intron with partial 5'UTR, *Arabidopsis thaliana*, Locus At1g65090, +77 to +531 bp (numbering relative to start of transcription) (+113 to +508 bp 5'UTR-Intron only) |
| c-d6Des(Ot_febit) | 7802 | 9172 | Delta-6 DESATURASE from *Ostreococcus tauri* |
| t-StCATHD-pA | 9200 | 9434 | Terminator from CATHEPSIN D INHIBITOR gene [CATHD] from *Solanum tuberosum* [Potato] |
| p-LuPXR 1727 bp[LLL823] | 9513 | 11239 | Promoter from PEROXIREDOXIN LIKE protein gene PXR from *Linum usitatissimum* |
| i-Atss1_846 bp[ltm593] | 11240 | 12085 | i-Atss1_847 bp functional intron region; intron with partial 5' UTR, *Arabidopsis thaliana*, Locus At1g62290 (aspartyl protease family protein), +1 to +847 bp (numbering relative to start of transcription) (+19 to +841 bp 5'UTR-Intron only); 1 bp at poly T stretch shorter compared to original i-Atss1_847 bp |
| c-d6Elo(Tp_GA2) | 12099 | 12917 | Delta-6 ELONGASE from *Thalassiosira pseudonana* |
| t-AtPXR 400 bp[LLL823] | 12973 | 13372 | Terminator from peroxiredoxin like protein gene PXR (At1g48130) from *Arabidopsis thaliana* |
| p-Napin A/B | 13542 | 14205 | Promoter from napA/B gene (napin, seed storage protein) from *Brassica napus* |

TABLE 1-continued

Genetic Elements of plasmid VC-LTM593-1qcz rc. Listed are the names of the elements, the position in VC-LTM593-1qcz rc (nucleotide number, note: start position was larger than stop position for elements encoded by the complementary strand of VC-LTM593-1qcz rc), the function and source of the element. The T-DNA integrated into the plant genome during the transformation process was flanked by a right border (nucleotides 59895 to 148 of VC-LTM593-1qcz rc) and a left border (nucleotides 43830 to 43695 of VC-LTM593-1qcz rc). Elements outside of that region (=vector backbone) are required for cloning and stable maintenance in *E. coli* and/or agrobacteria. The sequence of this vector is shown in SEQ ID NO: 3. The locations (of the e.g. of promoters, genes, introns, terminators and separators) in SEQ ID NO: 3 are indicted in the second and third column.

| Genetic Elements of plasmid VC-LTM593-1qcz rc | From | To | Description, Function and Source of Element |
|---|---|---|---|
| i-Atss14_377 bp[LJK32] | 14206 | 14582 | i-Atss14_377 bp[LJK32] functional intron region; intron with partial 5' UTR, *Arabidopsis thaliana*, Locus At5g63190, +166 to +542 bp (numbering relative to start of transcription) (+201 to +542 bp 5'UTR-Intron only) |
| c-d12Des(Ps_GA2) | 14589 | 15785 | Delta-12 DESATURASE from *Phythophthora sojae* |
| t-E9 | 15804 | 16361 | Terminator from Small Subunit of RuBisCo rbcS gene (E9) from *Pisum sativum* |
| p-BnSETL-v1[1234 bp] | 16454 | 17687 | SETL-v1 *Brassica napus* promoter |
| c-o3Des(Pir_GA) | 17690 | 18781 | Omega-3 DESATURASE from *Pythium irregulare* |
| t-BnSETL | 18803 | 19416 | SETL-v1 *Brassica napus* terminator |
| p-VfUSP_684 bp[LLL894] | 19495 | 20178 | Promoter from UNKNOWN SEED PROTEIN gene USP (accession: X56240) from *Vicia faba* |
| i-Atss18_252[LJK36] | 20179 | 20430 | i-Atss18_252 bp functional intron region; intron with partial 5' UTR, *Arabidopsis thaliana*, Locus At1g01170, +37 to +288 bp (numbering relative to start of transcription) (+72 to +282 bp 5'UTR-Intron only) |
| c-o3Des(Pi_GA2) | 20441 | 21526 | Omega-3-DESATURASE from *Phythophthora infestans* |
| t-CaMV35S | 21535 | 21750 | Terminator CaMV35S from 35S gene from Cauliflower mosaic virus |
| p-BnSETL-v1[1234 bp] | 21886 | 23119 | SETL-v1 *Brassica napus* promoter |
| c-d5Des(Tc_GA2) | 23122 | 24441 | Delta-5 DESATURASE from *Thraustochytrium* sp. ATCC21685 |
| t-BnSETL | 24463 | 25076 | SETL-v1 *Brassica napus* terminator |
| p-ARC5_perm1 | 25223 | 26373 | Promoter derived from a promoter from ARCILINE 5 gene from *Phaseolus vulgaris* |
| c-d4Des(Tc_GA3) | 26384 | 27943 | Delta-4 DESATURASE from *Thraustochytrium* sp. |
| t-pvarc | 27957 | 28556 | Terminator of ARC5 gene from *Phaseolus vulgaris* |
| p-LuPXR 1727 bp[LLL823] | 28649 | 30375 | Promoter from PEROXIREDOXIN LIKE protein gene PXR from *Linum usitatissimum* |
| i-Atss15_758 bp[LJK33] | 30376 | 31133 | i-Atss15_758 bp[LJK33] functional intron region; intron with partial 5'UTR, *Arabidopsis thaliana*, Locus At2g27040, +93 bp to +850 bp (numbering relative to start of transcription) (+128 to +847 bp 5'UTR-Intron only) |
| c-o3Des(Pir_GA) | 31149 | 32240 | Omega-3 DESATURASE from *Pythium irregulare* |
| t-AtPXR 400 bp[LLL823] | 32297 | 32696 | Terminator from PEROXIREDOXIN LIKE protein gene PXR (At1g48130) from *Arabidopsis thaliana* |
| p-LuCnl(1064 bp) | 32832 | 33895 | Promoter from CONLININ gene from *Linum usitatissimum* |
| i-Atss2_455 bp[LJK20] | 33896 | 34350 | i-Atss2_455 bp functional intron region; intron with partial 5'UTR, *Arabidopsis thaliana*, Locus At1g65090, +77 to +531 bp (numbering relative to start of transcription) (+113 to +508 bp 5'UTR-Intron only) |

TABLE 1-continued

Genetic Elements of plasmid VC-LTM593-1qcz rc. Listed are the names of the elements, the position in VC-LTM593-1qcz rc (nucleotide number, note: start position was larger than stop position for elements encoded by the complementary strand of VC-LTM593-1qcz rc), the function and source of the element. The T-DNA integrated into the plant genome during the transformation process was flanked by a right border (nucleotides 59895 to 148 of VC-LTM593-1qcz rc) and a left border (nucleotides 43830 to 43695 of VC-LTM593-1qcz rc). Elements outside of that region (=vector backbone) are required for cloning and stable maintenance in *E. coli* and/or agrobacteria. The sequence of this vector is shown in SEQ ID NO: 3. The locations (of the e.g. of promoters, genes, introns, terminators and separators) in SEQ ID NO: 3 are indicted in the second and third column.

| Genetic Elements of plasmid VC-LTM593-1qcz rc | From | To | Description, Function and Source of Element |
|---|---|---|---|
| c-d4Des(Pl_GA)2 | 34360 | 35697 | Delta-4 DESATURASE from *Pavlova lutheri* |
| t-AgrOCS 192 bp[LED12] | 35719 | 35910 | Terminator from OCTOPINE SYNTHASE gene OCS from *Agrobacterium tumefaciens* |
| p-BnFae1 | 36104 | 37533 | Promoter from Beta-KETOACYL-CoA SYNTHASE (FAE1.1) gene from *Brassica napus* |
| i-Atss1_847 bp[LJK19] | 37534 | 38380 | i-Atss1_847 bp functional intron region; intron with partial 5' UTR, *Arabidopsis thaliana*, Locus At1g62290 (aspartyl protease family protein), +1 to +847 bp (numbering relative to start of transcription) (+19 to +841 bp 5'UTR-Intron only); from Q01153-1/RTP6393. |
| c-d5Elo(Ot_GA3) | 38388 | 39290 | Delta-5 ELONGASE from *Ostreococcus tauri* |
| t-bnFae1 | 39307 | 39706 | Terminator from FATTY ACID ELONGASE (FAE1, At4g34520) gene of *Arabidopsis thaliana* |
| p-YPC105906_PcUbi4-2[long] | 39830 | 40806 | MTX Parsley UBI4-2 promoter with internal intron |
| c-AtAHASL_A122T_S653N[minusRES] | 40814 | 42826 | ACETOHYDROXYACID SYNTHASE LARGE-SUBUNIT gene/CDS from *Arabidopsis* with S653N (csr1-2) mutation and A122T SDM mutation minus restriction sites |
| t-AtAHAS-3'UTR[rtp4820] | 42827 | 43606 | *Arabidopsis* (dicot) AtAHASL 3' Un-translated Region [trimmed] terminator for ACETOHYDROXYACID SYNTHASE gene |
| b-LLB | 43830 | 43695 | Left T-DNA Left border from pTi15955 [Genbank #AF242881] |
| c-KanR_Tn903 | 45777 | 44962 | Kanamycin Resistance selection gene/CDS |
| p-Kan[lm500] | 45898 | 45778 | Promoter for Kanamycin resistance gene |
| o-ori-2 | 47051 | 47267 | ori-2 origin of replication |
| c-repE | 47361 | 48116 | repE gene/CDS |
| c-sopA | 48695 | 49870 | sapA gene/CDS |
| c-sopB | 49870 | 50841 | sopB gene/CDS |
| c-sopC/incD | 50914 | 51387 | incD/sopC partial gene/CDS |
| c-traI | 51890 | 51949 | traI gene/CDS |
| mf-traI—repA intergenic region | 51938 | 52300 | regulatory region of traR dependent quorum sensing regulon - containing 2 tra-boxes (see LI AND FARRAND JOURNAL OF BACTERIOLOGY, January 2000, p. 179-188) |
| o-repA | 52301 | 53518 | Rep-A gene from pTiC58 replicon (LI AND FARRAND JOURNAL OF BACTERIOLOGY, January 2000, p. 179 . . . 188) |
| rr-repB | 53748 | 54758 | rep-B gene from pTiC58 replicon (LI AND FARRAND JOURNAL OF BACTERIOLOGY, January 2000, p. 179 . . . 188) |
| o-repC | 54973 | 56292 | rep-C gene from pTiC58 replicon (LI AND FARRAND JOURNAL OF BACTERIOLOGY, January 2000, p. 179 . . . 188) |

TABLE 1-continued

Genetic Elements of plasmid VC-LTM593-1qcz rc. Listed are the names of the elements, the position in VC-LTM593-1qcz rc (nucleotide number, note: start position was larger than stop position for elements encoded by the complementary strand of VC-LTM593-1qcz rc), the function and source of the element. The T-DNA integrated into the plant genome during the transformation process was flanked by a right border (nucleotides 59895 to 148 of VC-LTM593-1qcz rc) and a left border (nucleotides 43830 to 43695 of VC-LTM593-1qcz rc). Elements outside of that region (=vector backbone) are required for cloning and stable maintenance in *E. coli* and/or agrobacteria. The sequence of this vector is shown in SEQ ID NO: 3. The locations (of the e.g. of promoters, genes, introns, terminators and separators) in SEQ ID NO: 3 are indicted in the second and third column.

| Genetic Elements of plasmid VC-LTM593-1qcz rc | From | To | Description, Function and Source of Element |
| --- | --- | --- | --- |
| mf-y4cG | 56771 | 56301 | fragment of DNA invertase homolog; similar to *Rhizobium* sp. NGR234 pNGR234a Y4CG |
| tr-Tn5 | 58811 | 57250 | Transposon Tn5 sequence |
| o-oriT | 59107 | 59275 | oriT from pRK310 genbank file |
| b-RB[rtp4394] | 148 | 59895 | Right T-DNA Right border |

D. Procedure for Production of Transgenic Plants Using BiBACs

In general, the transgenic rapeseed plants were generated by a modified protocol according to DeBlock et al. 1989, Plant Physiology, 91:694-701). Overnight cultures of the strain intended to be transformed was prepared in YEB medium with antibiotics (20 mg/L chloramphenicol, 5 mg/L tetracycline, 50 mg/L kanamycin) and grown at 28° C. On the next day the optical density of the culture was checked at 600 nm wave length. It reached about 1.0. Cultures of lower optical density were extended in cultivation period. Cultures with an optical density of above 1.3 were diluted with YEB medium to an OD of approximately 0.2 and cultured until they reached an OD of 1.0. Cultures were pelleted at about 4000 g and re-suspended in liquid MS medium (Murashige and Skoog 1962), pH 5.8, 3% sucrose with 100 mg/L Acetosyringone to reach an OD600 nm of 0.1. The *Agrobacterium* suspensions were used for inoculation of hypocotyl segments prepared from 5 days old etiolated seedlings.

Seeds were germinated for five days under low light conditions (<50 μMol/m2s) using MSB5 medium from Duchefa (Duchefa Biochemie, PO Box 809 2003 R V Haarlem, Netherlands), pH 5.8, 3% sucrose and 0.8% Oxoid agar. Germination under light conditions produces explants, which are more stable and easier to handle compared to etiolated hypocotyls. Hypocotyl segments of 4 to 7 mm length were inoculated in a bath of *Agrobacterium* cells under gentle shaking up to 4 min and sieved after the incubation. Infected explants were transferred to petri dishes with co-cultivation medium (MS medium, pH 5.6, 3% sucrose, 0.6 g/L MES (2-(N-Morpholino)ethanesulfonic acid), 18 g/L mannitol, 0.7% phytoagar (Duchefa Biochemie, PO Box 809 2003 R V Haarlem, Netherlands, part number SKU:P1003), 100 mg/L Acetosyringone, 200 mg/L L-Cysteine, 1 mg/L 2,4D (2,4-Dichlorophenoxyacetic acid)) carrying one layer of Whatman filter paper on its surface. Petri dishes were sealed with tape and incubated at 23 C under long day conditions (16 h light/8 h darkness) for three days. After the three days co-cultivation period explants were transferred to MS medium, pH 5.6, 3% sucrose, 0.6 g/L MES, 18 g/L mannitol, 07% Phytoagar, 1 mg/L 2,4D and 500 mg/L Carbenicillin to prevent *Agrobacterium* growth and incubated for a recovery period under the same physical conditions as for the co-cultivation for 7 days.

For selective regeneration explants were transferred after the recovery period to MS medium, pH 5.8, 3% sucrose, 0.7% Phytoagar, 2.5 mg/L AgNO$_3$, 3 mg/L BAP (6-Benzylaminopurine), 0.1 mg/L GA (Gibberellic acid), 0.1 mg/L NAA (1-Naphthaleneacetic acid), 500 mg/L Carbenicillin, 100 nM Imazethapyr (Pursuit) and cultured for two weeks under long day conditions as described above. Sub-cultivation takes place every two weeks. Hormones were stepwise reduced as follows: BAP 3 to 0.5 to 0.05 mg/L; GA (Gibberellic acid) 0.1 to 0.25 to 0.25 mg/L; NAA 0.1 to 0 to 0 mg/L. Developing shootlets could be harvested after the second cycle of selective regeneration. Shootlets were cut and transferred to either Elongation/rooting medium (MS medium, pH 5.8, 2% sucrose, 100 mg/L myo-inositol, 40 mg/L Adenine sulphate, 500 mg/L MES, 0.4% Sigma Agar, 150 mg/L Timentin, 0.1 mg/L IBA (Indole-3-butyric acid)) or to rock wool/stone wool or foam mats (Grodan, GRODAN Group P.O. Box 1160, 6040 KD Roermond The Netherlands, or Oasis, 919 Marvin Street, Kent, Ohio 44240 USA) watered with 1/10 Vol. of MS medium, pH 5.8 without sucrose under ex vitro long day conditions in covered boxes.

Shoots were elongated and rooted in in vitro medium and were transferred directly to soil.

Either in vitro shoots or GH adapted shoots were sampled for molecular analysis.

Medium were used either autoclaved (except antibiotics, hormones, additives such as L-cysteine, Acetosyringon, imidazolinone components) or filter sterilized prepared (Agar component autoclaved, allowed to cool to 42 C and then used).

E. Seed Germination and Plant Growth in the Greenhouse and Field

Transformed plants were cultivated for seed production and phenotypic assessment in both the greenhouse and in the field. Greenhouse growth conditions were a sixteen hour light period followed by an eight hour dark period. The temperature was 20 degrees celsius during the light period (also called the day period) with a level of light corresponding to 200-300 micromoles of photons m-2 s-1 (this is the incident of light at the top of the plant and lights were adjusted in terms of distance from the plant to achieve this rate). During the day period the range of light in the greenhouse varied between 130 and 500 micromoles of photons m-2 s-1. Getting out of the day range just cited triggered either the use of artificial light to bring the level up to 200-300 micromoles of photons m-2 s-1 or shading and/or shut off of lights to bring the level back to 200-300 micromoles of photons m-2 s-1. The dark period (also referred to as the night period) temperature was 18 C. Four hours before the light period began the temperature was lowered to 15 C for the remainder of the dark period. Plants were irrigated and treated for insects as necessary. The soil type was 50% Floradur B Seed+50% Floradur B Cutting (including sand and perlite) provided by Floragard (Oldenburg, Germany). Plant growth was enhanced by nutrient supplementation. Nutrients were combined with the daily watering. A 0.1% (w/v) fertilizer solution (Hakaphos Blue 15(N)-10 (P)-15 (K), Compo GmbH & Co KG, Münster, Germany) was used to water the plants. Water was supplied on demand (e.g. depending on plant growth stage, water consumption etc.). To avoid cross-pollination, plants were bagged at the time when the first flowers opened. Plants were checked daily in order to ensure that all open flowers were covered by the bags. Open flowers that were not covered properly were removed.

For field grown plants, the plants were grown in six locations which correspond climatically to USDA growth zones 3a-4b and 5a. The plants grown in the regions corresponding to USDA growth zones 3a-4b and 5a were grown in the summer. Standard horticultural practices for canola were followed. Netting and other measures to protect from birds and insects were used as deemed necessary by the growers, as were herbicides and fertilizer applications. The planting density for all locations was eighty seeds per square meter.

F. Lipid Extraction and Lipid Analysis of Plant Oils

The results of genetic modifications in plants or on the production of a desired molecule, e.g. a certain fatty acid, were determined by growing the plant under suitable conditions, e.g. as described above, and analyzing the growth media and/or the cellular components for enhanced production of the desired molecule, e.g. lipids or a certain fatty acid. Lipids were extracted as described in the standard literature including Ullman, Encyclopedia of Industrial Chemistry, Bd. A2, S. 89-90 and S. 443-613, VCH: Weinheim (1985); Fallon, A., et al., (1987) "Applications of HPLC in Biochemistry" in: Laboratory Techniques in Biochemistry and Molecular Biology, Bd. 17; Rehm et al. (1993) Biotechnology, Bd. 3, Kapitel III: "Product recovery and purification", S. 469-714, VCH: Weinheim; Better, P. A., et al. (1988) Bioseparations: downstream processing for Biotechnology, John Wiley and Sons; Kennedy, J. F., und Cabral, J. M. S. (1992) Recovery processes for biological Materials, John Wiley and Sons; Shaeiwitz, J. A., und Henry, J. D. (1988) Biochemical Separations, in: Ullmann's Encyclopedia of Industrial Chemistry, Bd. B3; Kapitel 11, S. 1-27, VCH: Weinheim; and Dechow, F. J. (1989) Separation and purification techniques in biotechnology, Noyes Publications.

It is acknowledged that extraction of lipids and fatty acids can be carried out using other protocols than those cited above, such as described in Cahoon et al. (1999) Proc. Natl. Acad. Sci. USA 96 (22):12935-12940, and Browse et al. (1986) Analytic Biochemistry 152:141-145. The protocols used for quantitative and qualitative analysis of lipids or fatty acids are described in Christie, William W., Advances in Lipid Methodology, Ayr/Scotland: Oily Press (Oily Press Lipid Library; 2); Christie, William W., Gas Chromatography and Lipids. A Practical Guide—Ayr, Scotland: Oily Press, 1989, Repr. 1992, IX, 307 S. (Oily Press Lipid Library; 1); "Progress in Lipid Research, Oxford: Pergamon Press, 1 (1952)-16 (1977) u.d.T.: Progress in the Chemistry of Fats and Other Lipids CODEN.

To generate transgenic plants containing the genetic elements described in example 1C for production of EPA and DHA in seeds, rapeseed (*Brassica napus*) was transformed as described in 1 D. Selected plants containing the genetic elements were grown until development of mature seeds under the conditions cited in Example 1E. Fatty acids from harvested seeds were extracted as described above and analyzed using gas chromatography as described above. The content (levels) of fatty acids is expressed throughout the present invention as percentage (weight of a particular fatty acid) of the (total weight of all fatty acids) contained in the oil of seeds. Seed oil content is expressed throughout the present invention as percentage of (oil weight) of the (total oil weight of seeds).

G. Compositional Analysis of Plant Seed Samples

The effect of genetic modification on seed composition was determined by growing plants under suitable conditions, e.g. as described above, and analyzing seed tissue for specific compositional parameters. Mature seed samples were milled into fine powder using a Foss Knifetec 1095 Sample Mill and provided to Eurofins Nutrition Analysis Center (ENAC). Specifically, Vitamin E (tocopherol) content was measured by in milled seeds samples by ENAC using methods MET-VT-008 and MET-VT-030, both of which refer to the Association Of Analytical Communities method AOAC 971.30, and involve HPLC separation and quantification.

Example 2: Plants Containing the T-DNA of Plasmid VC-LTM593-1Qcz Rc for Enhanced Production of Tocopherol, and EPA and DHA in Seeds All genetic elements described in this example were transferred on a single T-DNA using a BiBAC plasmid into the plant genome. To this end, the plasmid VC-LTM593-1qcz rc was cloned into agrobacteria, and plant tissue was incubated according to example 1 with this agrobacterial culture. The genetic elements of VC-LTM593-1qcz rc and the function of each element are listed in Table 1. For convenience, all enzymes expressed in seeds of plants carrying both T-DNA of VC-LTM593-1qcz rc are additionally listed Table 2. In an embodiment, the plant, plant part (in particular seed), T-DNA, or construct of the present invention comprises some desaturases and/or elongases, or all desaturases and/or elongases as disclosed in the Table.

TABLE 2

List of genes carried by the T-DNA of plasmid VC-LTM593-1qcz rc. Preferred polynucleotide and protein sequences are shown in column 4 and 5.

| Genes encoding enzmyes for EPA and DHA synthesis | Length (bp) | Enzymatic function and source of encoded protein | Polynucleotide SEQ ID NO: | Protein sequence SEQ ID NO |
|---|---|---|---|---|
| c-d12Des(Ps_GA2) | 1197 | Delta-12 desaturase from *Phythophthora sojae* | 265 | 266 |

TABLE 2-continued

List of genes carried by the T-DNA of plasmid VC-LTM593-1qcz rc. Preferred polynucleotide and protein sequences are shown in column 4 and 5.

| Genes encoding enzmyes for EPA and DHA synthesis | Length (bp) | Enzymatic function and source of encoded protein | Polynucleotide SEQ ID NO: | Protein sequence SEQ ID NO |
|---|---|---|---|---|
| c-d6Des(Ot_febit) | 1371 | Delta-6 desaturase from *Ostreococcus tauri* | 261 | 262 |
| c-d6Elo(Pp_GA2) | 873 | Delta-6 elongase from *Physcomitrella patens* | 257 | 258 |
| c-d6Elo(Tp_GA2) | 819 | Delta-6 elongase from *Thalassiosira pseudonana* | 263 | 264 |
| 2 copies of c-d5Des(Tc_GA2) | 1320 | Delta-5 desaturase from *Thraustochytrium* sp. ATCC21685 | 259 | 260 |
| c-o3Des(Pi_GA2) | 1086 | Omega-3-desaturase from *Phythophthora infestans* | 269 | 270 |
| 2 copies of c-o3Des(Pir_GA) | 1092 | Omega-3 desaturase from *Pythium irregulare* | 267 | 268 |
| c-d5Elo(Ot_GA3) | 903 | Delta-5 elongase from *Ostreococcus tauri* | 275 | 276 |
| c-d4Des(Pl_GA)2 | 1338 | Delta-4 desaturase from *Pavlova lutheri* | 273 | 274 |
| c-d4Des(Tc_GA3) | 1560 | Delta-4 desaturase from *Thraustochytrium* sp. | 271 | 272 |

A. Fatty acid profiles, and vitamin E content of T2 plants carrying T-DNAs of plasmids VC-LTM593-1qcz rc cultivated in field trials in USDA growth zones 3a-4b and 5a during the summer Homozygous T2 plants from six independent transgenic events that contained 1-2 copies of the T-DNA VC-LTM593-1qcz rc were grown in field locations according example 1. The T3 seeds were harvested and submitted for fatty acid analysis as described in example 1. Table 3 contains fatty acid profile data across all samples from all locations, for each event. Every event is capable of making VLC-PUFAs in the field (ARA, EPA and DHA).

The same T3 seeds described in Table 3 were submitted for compositional analysis as described in example 1. To analyze the data, ANOVA was conducted using the software JMP 11.0. Analysis was conducted at the 95% confidence level using Tukey test. To compensate for unbalance in the data obtained from the field trial (e.g. due to e.g. weather), Least Square means instead of means where used in the statistical analysis. Common letters in Table 3 indicate no significant difference of the least square means. Based on this statistical analysis, one event, LBFDAU, contains higher gamma tocopherol and total tocopherol than the untransformed Kumily control, while all other events tend to have higher gamma- and total tocopherol levels than Kumily, with the exception of event LBFIHE.

The transgenic events described in Tables 3 and 4 all have decreased 18:1+18:2 content relative to untransformed Kumily (18:1+18:2=80%). However, we did not observe any significant decrease in alpha-tocopherol content as would have been predicted based on Li et al. (2013) J Agric Food Chem 61:34-40. Instead, we observe increases in gamma-tocopherol and total tocopherol content, with the largest increase occurring in event LBFDAU that produces the most combined EPA+DHA. A correlation analysis was performed to reveal correlations between VLC-PUFA and tocopherols (Table 5). There we no significant correlations between ARA (an n-6 fatty acid) and any tocopherol components. On the other hand, significant positive correlations were observed between various tocopherols and EPA and DHA. Correlations coefficients were determined for the sum of all n-3 or all n-6 fatty acids 20 carbons in length or greater. The correlation between tocopherol of VLC-PUFA content is specific to n-3 fatty acids. The highest correlations were observed between n-3 fatty acids 20 carbon in length or greater and gamma-, delta-, and total tocopherols. Therefore, introduction of a biosynthetic pathway that synthesizes the 20 and 22 carbon n-3 VLC-PUFAs EPA, DPA, and DHA into plants also results in an increase in vitamin E content.

TABLE 3

Fatty acid profiles of T3 seeds harvested from T2 plants cultivated in the field, corresponding to USDA growth zones 3a-4b and 5a, for field trials of canola events containing the T-DNAs of plasmid VC-LTM593-1qcz rc. The events are indicated in the first column, along with the number of T3 seed aliquots representing a plot were measured per event. For event LBFGKN, 36 plots and 60 single plants from those plots where measured. Per seed batch a random selection of ~15 seed was measured in five technical repeats. Values are the least square means ± standard deviation.

| Event | 16:0 | 16:1 n-7 | 16:3 n-3 | 18:0 | 18:1 n-9 | 18:2 n-6 | 18:2 n-9 | 18:3 n-3 | 18:3 n-6 | 18:4 n-3 |
|---|---|---|---|---|---|---|---|---|---|---|
| LBFDAU (n = 16) | 4.7 ± 0.1 | 0.2 ± 0 | 0 ± 0 | 2.7 ± 0.1 | 28.6 ± 1.5 | 29.2 ± 0.7 | 1 ± 0.1 | 6.1 ± 0.3 | 1.6 ± 0.1 | 0.3 ± 0 |
| LBFDGG (n = 36) | 4.7 ± 0.1 | 0.2 ± 0 | 0 ± 0 | 2.5 ± 0.2 | 34.2 ± 1.9 | 32.3 ± 1.2 | 0.6 ± 0.1 | 7 ± 0.5 | 1.2 ± 0.1 | 0.2 ± 0 |

TABLE 3-continued

Fatty acid profiles of T3 seeds harvested from T2 plants cultivated in the field, corresponding to USDA growth zones 3a-4b and 5a, for field trials of canola events containing the T-DNAs of plasmid VC-LTM593-1qcz rc. The events are indicated in the first column, along with the number of T3 seed aliquots representing a plot were measured per event. For event LBFGKN, 36 plots and 60 single plants from those plots where measured. Per seed batch a random selection of ~15 seed was measured in five technical repeats. Values are the least square means ± standard deviation.

| | | | | | | | | | | |
|---|---|---|---|---|---|---|---|---|---|---|
| LBFGKN (n = 36 + 60) | 4.6 ± 0.2 | 0.2 ± 0 | 0 ± 0 | 2.6 ± 0.2 | 33.7 ± 1.7 | 32.8 ± 1.4 | 0.6 ± 0.1 | 7.5 ± 0.6 | 0.9 ± 0.1 | 0.2 ± 0 |
| LBFIHE (n = 36) | 4.8 ± 0.2 | 0.2 ± 0 | 0 ± 0 | 2.6 ± 0.2 | 31.2 ± 1.7 | 33.9 ± 1.2 | 0.6 ± 0.1 | 6.7 ± 0.7 | 1.3 ± 0.2 | 0.3 ± 0 |
| LBFLFK (n = 36) | 4.7 ± 0.2 | 0.2 ± 0 | 0 ± 0 | 2.6 ± 0.2 | 30.1 ± 1.9 | 30.2 ± 1.1 | 0.9 ± 0.1 | 6.2 ± 0.4 | 1.5 ± 0.2 | 0.3 ± 0.1 |
| LBFPRA (n = 36) | 4.8 ± 0.2 | 0.2 ± 0 | 0 ± 0 | 2.6 ± 0.2 | 28.4 ± 2.1 | 32.7 ± 1.4 | 0.8 ± 0.1 | 5.7 ± 0.4 | 1.6 ± 0.2 | 0.3 ± 0.1 |

| Event | 20:0 | 20:1 n-9 | 20:2 n-6 | 20:3 n-3 | 20:3 n-6 | 20:4 n-3 | 20:4 n-6 | 20:5 n-3 | 22:0 | 22:1 n-9 |
|---|---|---|---|---|---|---|---|---|---|---|
| LBFDAU (n = 16) | 0.7 ± 0 | 0.7 ± 0 | 0.1 ± 0 | 0.1 ± 0 | 3.3 ± 0.3 | 2.2 ± 0.2 | 2 ± 0.2 | 10.7 ± 0.7 | 0.3 ± 0 | 0 ± 0 |
| LBFDGG (n = 36) | 0.6 ± 0 | 0.8 ± 0 | 0.1 ± 0 | 0.1 ± 0 | 2 ± 0.3 | 1.3 ± 0.2 | 1.9 ± 0.2 | 6.1 ± 0.7 | 0.3 ± 0 | 0 ± 0 |
| LBFGKN (n = 36 + 60) | 0.7 ± 0 | 0.8 ± 0.1 | 0.2 ± 0 | 0.1 ± 0 | 2.1 ± 0.3 | 1.2 ± 0.1 | 1.8 ± 0.2 | 6 ± 0.6 | 0.3 ± 0 | 0 ± 0 |
| LBFIHE (n = 36) | 0.7 ± 0.1 | 0.8 ± 0 | 0.2 ± 0 | 0.1 ± 0 | 2.1 ± 0.2 | 1.2 ± 0.1 | 2.4 ± 0.3 | 6.7 ± 0.6 | 0.3 ± 0 | 0 ± 0 |
| LBFLFK (n = 36) | 0.6 ± 0 | 0.8 ± 0 | 0.1 ± 0 | 0.1 ± 0 | 3.3 ± 0.3 | 1.9 ± 0.2 | 1.9 ± 0.2 | 8.2 ± 1 | 0.3 ± 0 | 0 ± 0 |
| LBFPRA (n = 36) | 0.7 ± 0 | 0.8 ± 0 | 0.2 ± 0 | 0.1 ± 0 | 2.3 ± 0.3 | 1.2 ± 0.2 | 3.8 ± 0.5 | 9.6 ± 1 | 0.3 ± 0 | 0 ± 0 |

| Event | 22:4 n-6 | 22:5 n-3 | 22:5 n-6 | 22:6 n-3 | 22:4 n-3 | 20:2 n-9 |
|---|---|---|---|---|---|---|
| LBFDAU (n = 16) | 0.3 ± 0 | 2.9 ± 0.2 | 0.1 ± 0 | 1.6 ± 0.2 | 0.3 ± 0.1 | 0.3 ± 0 |
| LBFDGG (n = 36) | 0.3 ± 0 | 2.1 ± 0.2 | 0.1 ± 0 | 1.1 ± 0.2 | 0.2 ± 0.1 | 0.1 ± 0 |
| LBFGKN (n = 36 + 60) | 0.3 ± 0.1 | 2.1 ± 0.2 | 0.1 ± 0 | 1 ± 0.1 | 0.2 ± 0 | 0.2 ± 0 |
| LBFIHE (n = 36) | 0.3 ± 0.1 | 1.9 ± 0.2 | 0.1 ± 0 | 1.2 ± 0.2 | 0.2 ± 0.1 | 0.2 ± 0 |
| LBFLFK (n = 36) | 0.5 ± 0 | 3.2 ± 0.4 | 0.1 ± 0 | 1.4 ± 0.3 | 0.5 ± 0.1 | 0.3 ± 0.1 |
| LBFPRA (n = 36) | 0.3 ± 0 | 2.4 ± 0.3 | 0.1 ± 0 | 1.1 ± 0.2 | 0.1 ± 0 | 0.2 ± 0.1 |

TABLE 4

Compositional analysis of T3 seeds of T2 plants cultivated in USDA growth zones 3a-4b and 5a for field trials of canola events containing the T-DNAs of plasmid VC-VC-LTM593-1qcz rc. The events are indicated in the first column. The analysis has been done on 4 BULK, whereby each BULK is a representative sample of all seeds harvedted from 4 different geographic regions. Alpha-Tocopherol (mg/100 g seed), Beta-Tocopherol (mg/100 g seed), Delta-Tocopherol (mg/100 g seed), Gamma-Tocopherol (mg/100 g seed), Total Tocopherol (mg/100 g seed). All results have been normalized to the seed weight of seeds having 0% moisture. Values are the least square means. Means that are not sharing a letter aresignificantly different at the 95% confidence level.

| Event | Alpha-Tocopherol | | Beta-Tocopherol | | Delta-Tocopherol | | Gamma-Tocopherol | | Tocopherols (VitE) | | Oil (%) | |
|---|---|---|---|---|---|---|---|---|---|---|---|---|
| LBFDAU | 13.3 | ab | 0.25 | a | 0.58 | a | 29.5 | a | 43.7 | a | 37.716 | bcd |
| LBFDGG | 14.1 | ab | 0.23 | a | 0.45 | bcd | 25.6 | b | 40.4 | abc | 38.612 | abcd |
| LBFGKN | 12.9 | b | 0.23 | a | 0.52 | abc | 26.9 | ab | 40.6 | abc | 39.400 | abc |
| LBFIHE | 13.2 | ab | 0.23 | a | 0.45 | bcd | 22.0 | cd | 35.9 | cde | 39.639 | abc |
| LBFLFK | 12.5 | b | 0.23 | a | 0.52 | abc | 25.7 | b | 38.9 | abc | 37.233 | cd |
| LBFPRA | 13.6 | ab | 0.22 | a | 0.47 | bcd | 24.9 | bc | 39.2 | abc | 39.189 | abcd |
| Topas | 14.7 | ab | 0.25 | a | 0.36 | d | 16.6 | e | 31.9 | e | 36.581 | d |
| Kumily | 12.3 | b | 0.23 | a | 0.54 | ab | 24.4 | bc | 37.5 | bcd | 38.722 | abcd |
| Control 1* | 16.6 | a | 0.25 | a | 0.43 | cd | 24.1 | bc | 41.4 | ab | 38.923 | abcd |
| Control 2* | 12.0 | b | 0.20 | a | 0.45 | bcd | 20.8 | d | 33.5 | de | 40.567 | a |

*Controls 1 and 2 are not Kumily backgrounds

TABLE 5

Pearson correlation coefficients between fatty acids and tocopherols from T3 seeds of T2 plants cultivated in USDA growth zones 3a-4b and 5a for field trials of canola events containing the T-DNAs of plasmid VC-VC-LTM593-1qcz rc.

| Fatty Acid | Alpha-Tocopherol | Beta-Tocopherol | Gamma-Tocopherol | Delta-Tocopherol | Tocopherols (VitE) |
|---|---|---|---|---|---|
| ARA (20:4n-6) | 0.059 | −0.151 | −0.162 | −0.167 | −0.129 |
| EPA (20:5n-3) | 0.030 | 0.102 | 0.372* | 0.488*** | 0.389* |
| DPA (22:5n-3) | 0.080 | −0.035 | 0.001 | 0.147 | 0.056 |
| DHA (22:6n-3) | 0.222 | 0.449*** | 0.319 | 0.543*** | 0.447*** |
| total n-3 (>20C) | 0.029 | 0.159 | 0.416*** | 0.566*** | 0.432*** |
| total n-6 (<20C) | −0.082 | −0.119 | 0.143 | 0.218 | 0.096 |

Correlations that are significant are indicated with ***($p < 0.05$) or with *($p < 0.10$).

SEQUENCE LISTING (336 sequences)

SEQ ID NO: 1 - DNA, 60097 bp, Artificial Sequence
  plasmid
cctgccagtcagcatcatcacaccaaaagttaggcccgaatagtttgaaattagaaagctcgcaattgaggtctacaggccaaattcgctcttagccgtacaatattactcaccggtgcgatgccccccatcgtaggtgaaggtggaaattaatggcgcgcctgatcactgattagtaactattacgtaagcctacgtagcgtcacgtgacgttagctaacgctacgtagcctcagctgacgttacgtaagcctacgtagcgtcacgtgagcttagctaacgctacctaggctcagctgacgttacgtaacgctagctagcgtcactcctgcagcaaatttacacattgccactaaacgtctaaacccttgtaatttgtttttgttttactatgtgtgttatgtatttgatttgcgataaatttttatatttggtactaaatttataacaccttttatgctaacgtttgccaacacttagcaatttgcaagttgattaattgattctaaattatttttgtcttctaaatacatatactaatcaactggaaatgtaaatatttgctaatatttctactataggagaattaaagtgagtgaatatggtaccacaaggtttggagatttaattgttgcaatgctgcatggatggcatatacaccaaacattcaataattcttgaggataataatggtaccacacaagatttgaggtgcatgaacgtcacgtggacaaaaggtttagtaatttttcaagacaacaatgttaccacacacaagttttgaggtgcatgcatggatgccctgtggaaagtttaaaaatattttggaaatgatttgcatggaagccatgtgtaaaaccatgacatccacttggaggatgcaataatgaagaaaactacaaatttacatgcaactagttatgcatgtagtctatataatgaggattttgcaatactttcattcatacacactcactaagttttacacgattataatttcttcatagccagtactgtttaagcttcactgtctctgaatcggcaaaggtaaacgtatcaattattctacaaacccttttatttttcttttgaattaccgtcttcattggttatatgataacttgataagtaaagcttcaataattgaatttgatctgtgtttttttggccttaatactaaatccttacataagctttgttgcttctcctcttgtgagttgagtgttaagttgtaataatggttcactttcagctttagaagaaaccatggaagttgttgagaggttctacggagagttggatggaaaggtttcccaaggagtgaacgctttgttgggatctttcggagttgagttgactgataccccaactactaagggattgccactcgttgattctccaactccaattgtgttgggagtgtctgtttacttgaccatcgtgatcggaggattgctttggatcaaggctagagatctcaagccaagagcttctgagccattcttgttgcaagctttggtgttggtgcacaacttgttctgcttcgctttgtctctttacatgtgcgtgggtatcgcttaccaagctatcacctggagatattccttgtggggaaacgcttataacccaaagcacaaggagatggctatcctcgtttacctcttctacatgtccaagtacgtggagttcatggataccgtgatcatgatcctcaagagatccaccagacagatttctttcctccacgtgtaccaccactcttctatctcccttatctggtgggctattgctcaccacgctccaggaggagaggcttattggagtgctgctctcaactctggagtgcacgtgttgatgtacgcttactacttcttggctgcttgcttgagatcttccccaaagctcaagaacaagtacctcttctggggaagatacctcacccaattccagatgttccagttcatgctcaacttggtgcaagcttactacgatatgaaaaccaacgctccatatccacaatggctcatcaagatcctcttctactacatgatctccctcttgttcctcttcggaaacttctacgtgcaaaagtacatcaagccatccgatggaaagcaaaagggagctaagaccgagtgatcgacaagctcgagtttctccataataatgtgtgagtagttcccagataagggaattagggttcctatagggtttcgctcatgtgttgagcatataagaaacccttagtatgtatttgtatttgtaaaatacttctatcaataaaatttctaattcctaaaaccaaaatccagtactaaaatccagatcccccgaattaattcggcgttaattcagctagctagcctcagctgacgttacgtaacgctaggtagcgtcacgtgacgttagctaacgctaggtagcgtcagctgagcttacgtaagcgcttagcagatatttggtgtctaaatgtttattttgtgatatgttcatgtttgaaatggtggtttcgaaaccagggacaacgttgggatctgatagggtgtcaaagagtattatggattgggacaatttcggtcatgagttgcaaattcaagtatatcgttcgattatgaaaattttcgaagaatatcccatttgagagagtctttacctcattaatgtttttagattatgaaattttatcatagttcatcgtagtctttttggtgtaaaggctgtaaaaagaaattgttcacttttgttttcgtttatgtgaaggctgtaaaagattgtaaaagactattttggtgttttggataaaatgatagtttttatagattcttttgcttttagaagaaatacatttgaaattttttccatgttgagtataaaataccgaaatcgattgaagatcatagaaatattttaactgaaaacaaatttataactgattcaattctctccatttttatacctatttaaccgtaatcgattctaatagatgatcgattttttatataatcctaattaaccaacggcatgtattggataattaaccgatcaactctcacccctaatagaatcagtattttccttcgacgttaattgatcctacactatgtaggtcatatccatcgttttaatttttggccaccattcaattctgtcttgcctttagggatgtgaatatgaacggccaaggtaagagaataaaaataatccaaattaaagcaagagaggccaagtaagataatccaaatgtacacttgtcattgccaaaattagtaaaatactcggcatattgtattcccacacattattaaaataccgtatatgtattggctgcatttgcatgaataatactacgtgtaagcccaaaagaacccacgtgtagcccatgcaaagttaacactcacgaccccattcctcagtctccactatataaacccaccatccccaatctcaccaaacccaccacacaactcacaactcactctcacaccttaaagaaccaatcaccaccaaaaaatttcacgatttggaatttgattcctgcgatcacaggtatgacaggttagattttgttttgtatagttgtatacatacttctttgtgatgttttgtttacttaatcgaatttttggagtgttttaaggtctctcgtttagaaatcgtggaaaatatcactgtgtgtgtgttcttatgattcacagtgtttatgggtttcatgttctttgttttatcattgaatgggaagaaatttcgttgggatacaaatttctcatgttcttactgatcgttattaggagtttggggaaaaaggaagagtttttttggttggttcgagtgattatgaggttatttctgtatttgatttatgagttaatggtcgttttaatgttgtagaccatgggaaaaggatctgagggaagatctgctgctagagagatgactgctgaggctaacggagataagagaaagaccatcctcattgagggagtgttgtacgatgctaccaacttcaaacacccaggaggttccattattaacttcctcaccgagggagaagctggagttgatgctacccaagcttacagagagttccatcagagatccggaaaggctgataagtacctcaagtccctcccaaagttggatgcttctaaggtggagtctaggttctctgctaaggagcaggctagaagggacgctatgaccagggattacgctgctttcagagaggagttggttgctgagggatacttcgatccatctatcccacacatgatctacagagtggtggagattgtggctttgttcgctttgtctttctggttgatgtctaaggcttctccaacctctttggttttgggagtggtgatgaacggaatcgctcaaggaagatgcggatgggttatgcacgagatgggacacggatctttcactggagttatctggctcgatgataggatgtgcgagttcttctacggagttggatgtggaatgtctggacactactggaagaaccagcactctaagcaccacgctgctccaaacagattggagcacgatgtggatttgaacaccttgccactcgttgctttcaacgagagagttgtgaggaaggttaagccaggatctttgttggctttgtggctcagagttcaggcttatttgttcgctccagtgtcttgcttgttgatcggattgggatggaccttgtacttgcacccaagatatatgctcaggaccaagagacacatggagtttgtgtggatcttcgctagatatatcggatggttctccttgatgggagctttgggatattctcctggaacttctgtgggaatgtacctctgctctttcggacttggatgcatctacatcttcctccaattcgctgtgtctcacacccacttgccagttaccaacccagaggatcaattgcactggcttgagtacgctgctgatcacaccgtgaacatctctaccaagtcttggttggttacctggtggatgtctaacctcaacttccaaatcgagcaccacttgttcccaaccgctccacaattcaggttcaaggagatctctccaagagttgaggctctcttcaagagacacaacctcccttactacgatttgccatacacctctgctgtttctactaccttcgctaacctctactctgttggacactctgttggagctgataccaagaagcaggattgactgctttaatgagatatgcgagacgcctatgatcgcatgatatttgctttcaattctgttgtgcacgttgtaaaaaacctgagcatgtgtagctcagatccttaccgccggtttcggttcattctaatgaatatatcacccgttactatcgtatttttatgaataatattctccgttcaatttactgattgtctacgtaggctcagctgagcttacctaaggctacgtaggctcacgtgacgttacgtaaggctacgtagcgtcacgtgagcttacctaactctagctagcctcacgtgaccttagctaacactaggtagcgtcagctcgacggcccggactgtatccaacttctgatctttgaatctctctgttccaacatgttctgaaggagttctaagacttttcagaaagcttgtaacatgctttgtagactttctttgaattactcttgcaaactctgattgaacctacgtgaaaactgctccagaagttctaaccaaattccgtcttgggaaggcccaaaatttattgagtacttcagtttcatggacgtgtcttcaaagatttataacttgaaatcccatcatttttaagagaagttctgttccgcaatgtcttagatctcattgaaatctacaactcttgtgtcagaagttcttccagaatcaacttgcatcatggtgaaaatctggccagaagttctgaacttgtcatatttcttaacagttagaaaaatttctaagtgtttagaattttgacttttccaaagcaaacttgacttttgactttcttaataaaacaaacttcatattctaacatgtcttgatgaaatgtgattcttgaaatttgatgttgatgcaaaagtcaaagtttgacttttcagtgtgcaattgaccattttgctcttgtgccaattccaaacctaaattgatgtatcagtgctgcaaacttgatgtcatggaagatcttatgagaaaattcttgaagactgagaggaaaaattttgtagtacaacacaaagaatcctgtttttcatagtcggactagacacattaacataaaacaccacttcattcgaagagtgattgaagaaggaaatgtgcagttacctttctgcagttcataagagcaacttacagacacttttactaaaatactacaaagaggaagattttaacaacttagagaagtaatgggagttaaagagcaacacattaagggggagtgttaaaattaatgtgttgtaaccaccactacctttagtaagtattataagaaaattgtaatcatcacattataattattgtccttatttaaaattatgataaagttgtatcattaagattgagaaaaccaaatagtcctcgtcttgatttttgaattattgttttctatgttacttttcttcaagcctatataaaaactttgtaatgctaaattgtatgctggaaaaaaatgtgtaatgaattgaatagaaattatggtatttcaaagtccaaaatccatcaatagaaatttagtacaaaacgtaactcaaaaatattctcttattttaaattttacaacaatataaaaatattctcttattttaaattttacaataatataatttatcacctgtcacctttagaataccaccaacaatattaatacttagatattttattcttaataattttgagatctctcaatatatctgatatttattttatatttgtgtcatattttcttatgttttagagttaacccttatatcttggtcaaactagtaattcaatatatgagtttgtgaaggacacattgacatcttgaaacattggttttaaccttgttggaatgttaaaggtaataaaacattcagaattatgaccatctattaatatacttcctttgtcttttaaaaaagtgtgcatgaaaatgctctatggtaagctagagtgtcttgctggcctgtgtatatcaattccatttccagatggtagaaactgccactacgaataattagtcataagacacgtatgttaacacacgtccccttgcatgttttttgccatatattccgtctctttctttttcttcacgtataaaacaatgaactaattaatagagcgatcaagctgaacagttctttgctttcgaagttgccgcaacctaaacaggtttttccttcttctttcttcttattaactacgaccttgtcctttgcctatgtaaaattactaggttttcatcagttacactgattaagttcgttatagtggaagataaaatgccctcaaagcattttgcaggatatctttgatttttcaaagatatggaactgtagagtttgatagtgttcttgaatgtggttgcatgaagtttttttggtctgcatgttattttttcctcgaaatatgttttgagtccaacaagtgattcacttgggattcagaaagttgttttctcaatatgtaacagtttttttctatggagaaaaatcatagggaccgttggttttggcttctttaattttgagctcagattaaacccattttacccggtgttcttggcagaattgaaaacagtacgtagtaccgcgcctaccatgtgtgttgagaccgagaacaacgatggaatccctactgtggagatcgctttcgatggagagagagaaagagctgaggctaacgtgaagttgtctgctgagaagatggaacctgctgctttggctaagaccttcgctagaagatacgtggttatcgagggagttgagtacgatgtgaccgatttcaaacatcctggaggaaccgtgattttctacgctctctctaacactggagctgatgctactgaggctttcaaggagttccaccacagatctagaaaggctaggaaggctttggctgctttgccttctagacctgctaagaccgctaaagtggatgatgctgagatgctccaggatttcgctaagtggagaaaggagttggagagggacggattcttcaagccttctcctgctcatgttgcttacagattcgctgagttggctgctatgtacgctttgggaacctacttgatgtacgctagatacgttgtgtcctctgtgttggtttacgcttgcttcttcggagctagatgtggatgggttcaacacgagggaggacactcttctttgaccggaaacatctggtgggataagagaatccaagctttcactgctggattcggattggctggatctggagatatgtggaactccatgcacaacaagcaccacgctactcctcaaaaagtgaggcacgatatggatttggataccactcctgctgttgctttcttcaacaccgctgtggaggataatagacctaggggattctctaagtactggctcagattgcaagcttggaccttcattcctgtgacttctggattggtgttgctcttctggatgttcttcctccacccttctaaggctttgaagggaggaaagtacgaggagcttgtgtggatgttggctgctcacgtgattagaacctggaccattaaggctgttactggattcaccgctatgcaatcctacggactcttcttggctacttcttgggtttccggatgctacttgttcgctcacttctctacttctcacacccacttggatgttgttcctgctgatgagcacttgtcttgggttaggtacgctgtggatcacaccattgatatcgatccttctcagggatgggttaactggttgatgggatacttgaactgccaagtgattcaccacctcttcccttctatgcctcaattcagacaacctgaggtgtccagaagattcgttgctttcgctaagaagtggaacctcaactacaaggtgatgacttatgctggagcttggaaggctactttgggaaacctcgataatgtgggaaagcactactacgtgcacggacaacactctggaaagaccgcttgattaatgaaggccgcctcgaccgtaccccctgcagatagactatactatgttttagcctgcctgctggctagctactatgttatgttatgttgtaaaataaacacctgctaaggtatatctatctatattttagcatggctttctcaataaattgtctttccttatcgtttactatcttatacctaataatgaaataataatatcacatatgaggaacggggcaggtttaggcatatatatacgagtgtagggcggagtggggctacgtagcgtcacgtgacgttacctaagcctaggtagcctcagctgacgttacgtaacgctaggtaggctcagctgacacgggcaggacatagggactactacaagcatagtatgcttcagacaaagagctaggaaagaactcttgatggaggttaagagaaaaaagtgctagaggggcatagtaatcaaacttgtcaaaaccgtcatcatgatgagggatgacataatataaaaagttgactaaggtcttggtagtactctttgattagtattatatattggtgagaacatgagtcaagaggagacaagaaaccgaggaaccatagtttagcaacaagatggaagttgcaaagttgagctagccgctcgattagttacatctcctaagcagtactacaaggaatggtctctatactttcatgtttagcacatggtagtgcggattgacaagttagaaacagtgcttaggagacaaagagtcagtaaaggtattgaaagagtgaagttgatgctcgacaggtcaggagaagtccctccgccagatggtgactaccaaggggttggtatcagctgagacccaaataagattcttcggttgaaccagtggttcgaccgagactcttagggtgggatttcactgtaagatttgtgcattttgttgaatataaattgacaattttttttatttaattatagattatttagaatgaattacatatttagtttctaacaaggatagcaatggatgggtatgggtacaggttaaacatatctattacccacccatctagtcgtcgggttttacacgtacccacccgtttacataaaccagaccggaattttaaaccgtacccgtccgttagcgggtttcagatttacccgtttaatcgggtaaaacctgattactaaatatatattttttatttgataaacaaaacaaaaatgttaatattttcatattggatgcaattttaagaaacacatattcataaatttccatatttgtaggaaaataaaaagaaaaatatattcaagaacacaaatttcaccgacatgacttttattacagagttggaattagatctaacaattgaaaaattaaaattaagatagaatatgttgaggaacatgacatagtataatgctgggttacccgtcgggtaggtatcgaggcggatactactaaatccatcccactcgctatccgataatcactggtttcgggtatacccattcccgtcaacaggcctttttaaccggataatttcaacttatagtgaatgaattttgaataaatagttagaataccaaaatcctggattgcatttgcaatcaaattttgtgaaccgttaaattttgcatgtacttgggatagatataatagaaccgaattttcattagtttaatttataacttactttgttcaaagaaaaaaaatatctatccaatttacttataataaaaaataatctatccaagttacttattataatcaacttgtaaaaaggtaagaatacaaatgtggtagcgtacgtgtgattatatgtgacgaaatgttatatctaacaaaagtccaaattcccatggtaaaaaaaatcaaaatgcatggcaggctgtttgtaaccttggaataagatgttggccaattctggagccgccacgtacgcaagactcagggccacgttctcttcatgcaaggatagtagaacaccactccacccacctcctatattagacctttgcccaaccctccccaactttcccatcccatccacaaagaaaccgacatttttatcataaatctggtgcttaaacactctggtgagttctagtacttctgctatgatcgatctcattaccatttcttaaatttctctccctaaatattccgagttcttgatttttgataacttcaggttttctctttttgataaatctggtctttccatttttttttttttgtggttaatttagtttcctatgttcttcgattgtattatgcatgatctgtgtttggattctgttagattatgtattggtgaatatgtatgtgtttttgcatgtctggttttggtcttaaaaatgttcaaatctgatgatttgattgaagcttttttagtgttggtttgattcttctcaaaactactgttaatttactatcatgttttccaactttgattcatgatgacacttttgttctgctttgttataaaattttggttggtttgattttgtaattatagtgtaattttgttaggaatgaacatgttttaatactctgttttcgatttgtcacacattcgaattattaatcgataatttaactgaaaattcatggttctagatcttgttgtcatcagattatttgtttcgataattcatcaaatatgtagtccttttgctgatttgcgactgtttcattttttctcaaaattgttttttgttaagtttatctaacagttatcgttgtcaaaagtctctttcattttgcaaaatcttctttttttttttgtttgtaactttgttttttaagctacacatttagtctgtaaaatagcatcgaggaacagttgtcttagtagacttgcatgttcttgtaacttctatttgtttcagtttgttgatgactgctttgattttgtaggtcaaaggcgcaccctaccatggatgcttataacgctgctatggataagattggagctgctatcatcgattggagtgatccagatggaaagttcagagctgatagggaggattggtggttgtgcgatttcagatccgctatcaccattgctctcatctacatcgctttcgtgatcttgggatctgctgtgatgcaatctctcccagctatggacccataccctatcaagttcctctacaacgtgtctcaaatcttcctctgcgcttacatgactgttgaggctggattcctcgcttataggaacggatacaccgttatgccatgcaaccacttcaacgtgaacgatccaccagttgctaacttgctctggctcttctacatctccaaagtgtgggatttctgggataccatcttcattgtgctcggaaagaagtggagacaactctctttcttgcacgtgtaccaccacaccaccatcttcctcttctactggttgaacgctaacgtgctctacgatggagatatcttcttgaccatcctcctcaacggattcattcacaccgtgatgtacacctactacttcatctgcatgcacaccaaggattctaagaccggaaagtctttgccaatctggtggaagtcatctttgaccgctttccaactcttgcaattcaccatcatgatgtcccaagctacctacttggttttccacggatgcgataaggtttccctcagaatcaccatcgtgtacttcgtgtacattctctcccttttcttcctcttcgctcagttcttcgtgcaatcctacatggctccaaagaagaagaagtccgcttgatgttaatgaaggccgcagatatcagatctggtcgacctagaggatccccggccgcaaagataataacaaaagcctactatataacgtacatgcaagtattgtatgatattaatgtttttacgtacgtgtaaacaaaaataattacgtttgtaacgtatggtgatgatgtggtgcactaggtgtaggccttgtattaataaaaagaagtttgttctatatagagtggtttagtacgacgatttatttactagtcggattggaatagagaaccgaattcttcaatccttgcttttgatcaagaattgaaaccgaatcaaatgtaaaagttgatatatttgaaaaacgtattgagcttatgaaaatgctaatactctcatctgtatggaaaagtgactttaaaaccgaacttaaaagtgacaaaaggggaatatcgcatcaaaccgaatgaaaccgatctacgtaggctcagctgagcttagctaagcctacctagcctcacgtgagattatgtaaggctaggtagcgtcacgtgacgttacctaacactagctagcgtcagctgagcttagctaaccctacgtagcctcacgtgagcttacctaacgctacgtagcctcacgtgactaaggatgacctacccattcttgagacaaatgttacattttagtatcagagtaaaatgtgtacctataactcaaattcgattgacatgtatccattcaacataaaattaaaccagcctgcacctgcatccacatttcaagtattttcaaaccgttcggctcctatccaccgggtgtaacaagacggattccgaatttggaagattttgactcaaattcccaatttatattgaccgtgactaaatcaactttaacttctataattctgattaagctcccaatttatattcccaacggcactacctccaaaatttatagactctcatccccttttaaaccaacttagtaaacgttttttttttaattttatgaagttaagtttttaccttgtttttaaaaagaatcgttcataagatgccatgccagaacattagctacacgttacacatagcatgcagccgcggagaattgtttttcttcgccacttgtcactcccttcaaacacctaagagcttctctctcacagcacacacatacaatcacatgcgtgcatgcattattacacgtgatcgccatgcaaatctcctttatagcctataaattaactcatcggcttcactctttactcaaaccaaaactcatcaatacaaacaagattaaaaacatttcacgatttggaatttgattcctgcgatcacaggtatgacaggttagattttgttttgtatagttgtatacatacttctttgtgatgttttgtttacttaatcgaatttttggagtgttttaaggtctctcgtttagaaatcgtggaaaatatcactgtgtgtgtgttcttatgattcacagtgtttatgggtttcatgttctttgttttatcattgaatgggaagaaatttcgttgggatacaaatttctcatgttcttactgatcgttattaggagtttggggaaaaaggaagagtttttttggttggttcgagtgattatgaggttatttctgtatttgatttatgagttaatggtcgttttaatgttgtagaccgccatggctattttgaaccctgaggctgattctgctgctaacctcgctactgattctgaggctaagcaaagacaattggctgaggctggatacactcacgttgagggtgctcctgctcctttgcctttggagttgcctcacttctctctcagagatctcagagctgctattcctaagcactgcttcgagagatctttcgtgacctccacctactacatgatcaagaacgtgttgacttgcgctgctttgttctacgctgctaccttcattgatagagctggagctgctgcttatgttttgtggcctgtgtactggttcttccagggatcttacttgactggagtgtgggttatcgctcacgagtgtggacaccaggcttattgctcttctgaggtggtgaacaacttgattggactcgtgttgcactctgctttgttggtgccttaccactcttggagaatctctcacagaaagcaccactccaacactggatcttgcgagaacgatgaggttttcgttcctgtgaccagatctgtgttggcttcttcttggaacgagaccttggaggattctcctctctaccaactctaccgtatcgtgtacatgttggttgttggatggatgcctggatacctcttcttcaacgctactggacctactaagtactggggaaagtctaggtctcacttcaacccttactccgctatctatgctgatagggagaggtggatgatcgtgctctccgatattttcttggtggctatgttggctgttttggctgctttggtgcacactttctccttcaacacgatggtgaagttctacgtggtgccttacttcattgtgaacgcttacttggtgttgattacctacctccaacacaccgatacctacatccctcacttcagagagggagagtggaattggttgagaggagctttgtgcactgtggatagatcatttggtccattcctcgattctgtggtgcatagaatcgtggatacccacgtttgccaccatatcttctccaagatgcctttctatcactgcgaggaggctaccaacgctattaagcctctcctcggaaagttctacttgaaggatactactcctgttcctgttgctctctggagatcttacacccactgcaagttcgttgaggatgatggaaaggtggtgttctacaagaacaagttatagttaatgaataattgattggttcgagtattatggcattgggaaaactgtttttcttgtaccatttgttgtgcttgtaatttactgtgttttttattcggttttcgctatcgaactgtgaaatggaaatggatggagaagagttaatgaatgatatggtccttttgttcattctcaaattaatattatttgttttttctcttatttgttgtgtgttgaatttgaaattataagagatatgcaaacattttgttttgagtaaaaatgtgtcaaatcgtggcctctaatgaccgaagttaatatgaggagtaaaacacttgtagttgtaccattatgcttattcactaggcaacaaatatattttcagacctagaaaagctgcaaatgttactgaatacaagtatgtcctcttgtgttttagacatttatgaactttcctttatgtaattttccagaatccttgtcagattctaatcattgctttataattatagttatactcatggatttgtagttgagtatgaaaatattttttaatgcattttatgacttgccaattgattgacaacatgcatcaatgcggccgctagctagcctcagctgacgttacgtaacgctaggtagcgtcacgtgacgttagctaacgctaggtagcgtcagctgagcttacgtaagcgccacgggcaggacatagggactactacaagcatagtatgcttcagacaaagagctaggaaagaactcttgatggaggttaagagaaaaaagtgctagaggggcatagtaatcaaacttgtcaaaaccgtcatcatgatgagggatgacataatataaaaagttgactaaggtcttggtagtactctttgattagtattatatattggtgagaacatgagtcaagaggagacaagaaaccgaggaaccatagtttagcaacaagatggaagttgcaaagttgagctagccgctcgattagttacatctcctaagcagtactacaaggaatggtctctatactttcatgtttagcacatggtagtgcggattgacaagttagaaacagtgcttaggagacaaagagtcagtaaaggtattgaaagagtgaagttgatgctcgacaggtcaggagaagtccctccgccagatggtgactaccaaggggttggtatcagctgagacccaaataagattcttcggttgaaccagtggttcgaccgagactcttagggtgggatttcactgtaagatttgtgcattttgttgaatataaattgacaattttttttatttaattatagattatttagaatgaattacatatttagtttctaacaaggatagcaatggatgggtatgggtacaggttaaacatatctattacccacccatctagtcgtcgggttttacacgtacccacccgtttacataaaccagaccggaattttaaaccgtacccgtccgttagcgggtttcagatttacccgtttaatcgggtaaaacctgattactaaatatatattttttatttgataaacaaaacaaaaatgttaatattttcatattggatgcaattttaagaaacacatattcataaatttccatatttgtaggaaaataaaaagaaaaatatattcaagaacacaaatttcaccgacatgacttttattacagagttggaattagatctaacaattgaaaaattaaaattaagatagaatatgttgaggaacatgacatagtataatgctgggttacccgtcgggtaggtatcgaggcggatactactaaatccatcccactcgctatccgataatcactggtttcgggtatacccattcccgtcaacaggcctttttaaccggataatttcaacttatagtgaatgaattttgaataaatagttagaataccaaaatcctggattgcatttgcaatcaaattttgtgaaccgttaaattttgcatgtacttgggatagatataatagaaccgaattttcattagtttaatttataacttactttgttcaaagaaaaaaaatatctatccaatttacttataataaaaaataatctatccaagttacttattataatcaacttgtaaaaaggtaagaatacaaatgtggtagcgtacgtgtgattatatgtgacgaaatgttatatctaacaaaagtccaaattcccatggtaaaaaaaatcaaaatgcatggcaggctgtttgtaaccttggaataagatgttggccaattctggagccgccacgtacgcaagactcagggccacgttctcttcatgcaaggatagtagaacaccactccacccacctcctatattagacctttgcccaaccctccccaactttcccatcccatccacaaagaaaccgacatttttatcataaatcagggtttcgtttttgtttcatcgataaactcaaaggtgatgattttagggtcttgtgagtgtgcttttttgtttgattctactgtagggtttatgttctttagctcataggttttgtgtatttcttagaaatgtggcttctttaatctctgggtttgtgactttttgtgtggtttctgtgtttttcatatcaaaaacctattttttccgagtttttttttacaaattcttactctcaagcttgaatacttcacatgcagtgttcttttgtagattttagagttaatgtgttaaaaagtttggatttttcttgcttatagagcttcttcactttgattttgtgggtttttttgttttaaaggtgagatttttgatgaggtttttgcttcaaagatgtcacctttctgggtttgtcttttgaataaagctatgaactgtcacatggctgacgcaattttgttactatgtcatgaaagctgacgtttttccgtgttatacatgtttgcttacacttgcatgcgtcaaaaaaattggggctttttagttttagtcaaagattttacttctcttttgggatttatgaaggaaagttgcaaactttctcaaattttaccatttttgctttgatgtttgtttagattgcgacagaacaaactcatatatgttgaaatttttgcttggttttgtataggattgtgtcttttgcttataaatgttgaaatctgaactttttttttgtttggtttctttgagcaggagataaggcgcaccaccatggcttctacatctgctgctcaagacgctgctccttacgagttcccttctctcactgagatcaagagggctcttccttctgagtgtttcgaggcttctgttcctctttctctctactacaccgctagatctcttgctcttgctggatctctcgctgttgctctctcttacgctagagctttgcctcttgttcaggctaacgctcttcttgatgctactctctgcactggatacgttcttctccagggaatcgttttctggggattcttcaccgttggtcacgattgtggacacggagctttctctagatctcacgtgctcaacttctctgttggaaccctcatgcactctatcatccttacccctttcgagtcttggaagctctctcacagacaccaccacaagaacaccggaaacatcgataaggacgagatcttctaccctcaaagagaggctgattctcaccctgtttctagacaccttgtgatgtctcttggatctgcttggttcgcttaccttttcgctggattccctcctagaaccatgaaccacttcaacccttgggaggctatgtatgttagaagagtggctgctgtgatcatctctctcggagttcttttcgctttcgctggactctactcttacctcaccttcgttcttggattcaccactatggctatctactacttcggacctctcttcatcttcgctaccatgcttgttgttaccactttcctccaccacaacgatgaggagacaccttggtacgctgattctgagtggacttacgtgaagggaaacctctcttctgtggacagatcttacggtgctctcatcgacaaccttagccacaacatcggaactcaccagatccaccacctcttccctatcatccctcactacaagctcaacgatgctactgctgctttcgctaaggctttccctgagcttgttaggaaaaacgctgctcctatcatcccaactttcttcaggatggctgctatgtacgctaagtacggagttgttgacactgatgctaagaccttcactctcaaggaggctaaggctgctgctaagactaagtcatcttgatgattaatgaaggccgcagatatcagatctggtcgacctagaggatccccggccgcaaagataataacaaaagcctactatataacgtacatgcaagtattgtatgatattaatgtttttacgtacgtgtaaacaaaaataattacgtttgtaacgtatggtgatgatgtggtgcactaggtgtaggccttgtattaataaaaagaagtttgttctatatagagtggtttagtacgacgatttatttactagtcggattggaatagagaaccgaattcttcaatccttgcttttgatcaagaattgaaaccgaatcaaatgtaaaagttgatatatttgaaaaacgtattgagcttatgaaaatgctaatactctcatctgtatggaaaagtgactttaaaaccgaacttaaaagtgacaaaaggggaatatcgcatcaaaccgaatgaaaccgatctacgtaggctcagctgagcttacctaaggctacgtaggctcacgtgacgttacgtaaggctacgtagcgtcacgtgagcttacctaactctagctagcctcacgtgaccttagctaacactaggtagcgtcagcttagcagatatttggtgtctaaatgtttattttgtgatatgttcatgtttgaaatggtggtttcgaaaccagggacaacgttgggatctgatagggtgtcaaagagtattatggattgggacaatttcggtcatgagttgcaaattcaagtatatcgttcgattatgaaaattttcgaagaatatcccatttgagagagtctttacctcattaatgtttttagattatgaaattttatcatagttcatcgtagtctttttggtgtaaaggctgtaaaaagaaattgttcacttttgttttcgtttatgtgaaggctgtaaaagattgtaaaagactattttggtgttttggataaaatgatagtttttatagattcttttgcttttagaagaaatacatttgaaattttttccatgttgagtataaaataccgaaatcgattgaagatcatagaaatattttaactgaaaacaaatttataactgattcaattctctccatttttatacctatttaaccgtaatcgattctaatagatgatcgattttttatataatcctaattaaccaacggcatgtattggataattaaccgatcaactctcacccctaatagaatcagtattttccttcgacgttaattgatcctacactatgtaggtcatatccatcgttttaatttttggccaccattcaattctgtcttgcctttagggatgtgaatatgaacggccaaggtaagagaataaaaataatccaaattaaagcaagagaggccaagtaagataatccaaatgtacacttgtcattgccaaaattagtaaaatactcggcatattgtattcccacacattattaaaataccgtatatgtattggctgcatttgcatgaataatactacgtgtaagcccaaaagaacccacgtgtagcccatgcaaagttaacactcacgaccccattcctcagtctccactatataaacccaccatccccaatctcaccaaacccaccacacaactcacaactcactctcacaccttaaagaaccaatcaccaccaaaaaaagttctttgctttcgaagttgccgcaacctaaacaggtttttccttcttctttcttcttattaactacgaccttgtcctttgcctatgtaaaattactaggttttcatcagttacactgattaagttcgttatagtggaagataaaatgccctcaaagcattttgcaggatatctttgatttttcaaagatatggaactgtagagtttgatagtgttcttgaatgtggttgcatgaagtttttttggtctgcatgttattttttcctcgaaatatgttttgagtccaacaagtgattcacttgggattcagaaagttgttttctcaatatgtaacagtttttttctatggagaaaaatcatagggaccgttggttttggcttctttaattttgagctcagattaaacccattttacccggtgttcttggcagaattgaaaacagtacgtagtaccatttaaatgcgcctaccatgccacctagtgctgctagtgaaggtggtgttgctgaacttagagctgctgaagttgctagctacactagaaaggctgttgacgaaagacctgacctcactatagttggtgacgctgtttacgacgctaaggcttttagggacgagcaccctggtggtgctcacttcgttagccttttcggaggtagggacgctactgaggcttttatggaatatcaccgtagagcttggcctaaggctaggatgtctaagttcttcgttggttcacttgacgctagcgagaagcctactcaagctgattcagcttaccttagactttgcgctgaggttaacgctcttttgcctaagggtagcggaggattcgctcctcctagctactggcttaaggctgctgctcttgttgttgctgctgttagtatagagggttatatgctccttaggggtaagacccttttgcttagcgttttccttggactcgtgttcgcttggataggacttaatattcagcacgacgctaatcacggtgctcttagtagacactcagtgattaactactgcctcggttacgctcaggattggataggtggtaatatggtgctttggcttcaagagcacgttgtgatgcaccacctccacactaacgacgttgacgctgatcctgatcaaaaggctcacggtgttcttagacttaagcctactgacggttggatgccttggcacgcacttcaacaactctatatccttcctggtgaggctatgtacgcttttaagcttcttttcttggacgcccttgagcttcttgcttggaggtgggagggtgagaagattagccctcttgctagagctttgttcgctcctgctgttgcttgtaagcttggattctgggctagattcgttgctctccctctctggcttcaacctactgttcacactgctttgtgtatctgtgctactgtgtgtactggtagcttctacctcgccttcttcttctttatctctcacaacttcgacggtgttggtagcgttggacctaagggatcacttcctagatcagctactttcgttcaacgtcaggttgagactagctctaacgttggtggttactggcttggagttcttaacggtggacttaactttcagatagagcaccacttgttccctaggcttcaccactcttactacgctcaaatagctcctgtggttaggactcacatagagaagctcggttttaagtaccgtcacttccctaccgttggatctaaccttagctcaatgcttcagcatatgggtaagatgggaactagacctggtgctgagaagggtggtaaggctgagtagtgattaatgaataattgattgctgctttaatgagatatgcgagacgcctatgatcgcatgatatttgctttcaattctgttgtgcacgttgtaaaaaacctgagcatgtgtagctcagatccttaccgccggtttcggttcattctaatgaatatatcacccgttactatcgtatttttatgaataatattctccgttcaatttactgattgtctacgtagcgtcacctgacgttacgtaaggctacctaggctcacgtgacgttacgtaacgctacgtagcgtcaggtgaggttagctaacgctagctagcctcacctgacgttaggtaaggctacgtagcgtcacctgagattagctaagcctacctagactcacgtgaccttaggtaacgctacgtagcgtcaaagctttacaacgctacacaaaacttataaccgtaatcaccattcattaacttaactactatcacatgcattcatgaattgaaacgagaaggatgtaaatagttgggaagttatctccacgttgaagagatcgttagcgagagctgaaagaccgagggaggagacgccgtcaacacggacagagtcgtcgaccctcacatgaagtaggaggaatctccgtgaggagccagagagacgtctttggtcttcggtttcgatccttgatctgacggagaagacgagagaagtgcgactggactccgtgaggaccaacagagtcgtcctcggtttcgatcgtcggtattggtggagaaggcggaggaatctccgtgacgagccagagagatgtcgtcggtcttcggtttcgatccttgatctgacggagaagacgagagaagtgcgacgagactccgtgaggaccaacagagttgtcctcggtttcgatcgtcggtttcggcggagaaggcggaggaatctccgtgaggagccagagagacgtcgttggtcttcggtttcgatccttgatctgttggagaagacgagacaagtgggacgagactcaacgacggagtcagagacgtcgtcggtcttcggtttcggccgagaaggcggagtcggtcttcggtttcggccgagaaggcggaggagacgtcttcgatttgggtctctcctcttgacgaagaaaacaaagaacacgagaaataatgagaaagagaacaaaagaaaaaaaaataaaaataaaaataaaatttggtcctcttatgtggtgacacgtggtttgaaacccaccaaataatcgatcacaaaaaacctaagttaaggatcggtaataacctttctaattaattttgatttatattaaatcactctttttatttataaaccccactaaattatgcgatattgattgtctaagtacaaaaattctctcgaattcaatacacatgtttcatatatttagccctgttcatttaatattactagcgcatttttaatttaaaattttgtaaacttttttggtcaaagaacatttttttaattagagacagaaatctagactctttatttggaataatagtaataaagatatattaggcaatgagtttatgatgttatgtttatatagtttatttcattttaaattgaaaagcattatttttatcgaaatgaatctagtatacaatcaatatttatgttttttcatcagatactttcctattttttggcacctttcatcggactactgatttatttcaatgtgtatgcatgcatgagcatgagtatacacatgtcttttaaaatgcatgtaaagcgtaacggaccacaaaagaggatccatacaaatacatctcatcgcttcctctactattctccgacacacacactgagcatggtgcttaaacactctggtgagttctagtacttctgctatgatcgatctcattaccatttcttaaatttctctccctaaatattccgagttcttgatttttgataacttcaggttttctctttttgataaatctggtctttccattttttttttttttgtggttaatttagtttcctatgttcttcgattgtattatgcatgatctgtgtttggattctgttagattatgtattggtgaatatgtatgtgtttttgcatgtctggttttggtcttaaaaatgttcaaatctgatgatttgattgaagcttttttagtgttggtttgattcttctcaaaactactgttaatttactatcatgttttccaactttgattcatgatgacacttttgttctgctttgttataaaattttggttggtttgattttgtaattatagtgtaattttgttaggaatgaacatgttttaatactctgttttcgatttgtcacacattcgaattattaatcgataatttaactgaaaattcatggttctagatcttgttgtcatcagattatttgtttcgataattcatcaaatatgtagtccttttgctgatttgcgactgtttcattttttctcaaaattgttttttgttaagtttatctaacagttatcgttgtcaaaagtctctttcattttgcaaaatcttctttttttttttgtttgtaactttgttttttaagctacacatttagtctgtaaaatagcatcgaggaacagttgtcttagtagacttgcatgttcttgtaacttctatttgtttcagtttgttgatgactgctttgattttgtaggtcaaaccgcgccatgtctgctagcggagctttgttgcctgctatagctttcgctgcttacgcttacgctacctacgcttatgctttcgagtggagccacgctaacggaatcgataacgtggatgctagagagtggattggagctttgtctttgagactccctgcaattgcaaccacaatgtacctcttgttctgccttgtgggacctagattgatggctaagagggaggcttttgatcctaagggatttatgctcgcttacaacgcttaccaaaccgctttcaacgttgtggtgctcggaatgttcgctagagagatctctggattgggacaacctgtttggggatctactatgccttggagcgataggaagtccttcaagattttgttgggagtgtggctccactacaacaataagtacctcgagttgttggatactgtgttcatggtggctaggaaaaagaccaagcagctctctttcttgcacgtgtaccaccacgctttgttgatttgggcttggtggcttgtttgtcacctcatggctaccaacgattgcatcgatgcttatttcggagctgcttgcaactctttcatccacatcgtgatgtactcctactacctcatgtctgctttgggaattaggtgcccttggaagagatatatcacccaggctcagatgttgcaattcgtgatcgtgttcgctcacgctgttttcgtgctcagacaaaagcactgccctgttactttgccttgggcacaaatgttcgtgatgacaaatatgttggtgctcttcggaaacttctacctcaaggcttactctaacaagtctaggggagatggagcttcttctgttaagcctgctgagactactagagcaccttctgtgagaagaaccaggtcaaggaagatcgattgatagttaatgaactaagtttgatgtatctgagtgccaacgtttactttgtctttcctttcttttattggttatgattagatgtttactatgttctctctttttcgttataaataaagaagttcaattcttctatagtttcaaacgcgattttaagcgtttctatttaggtttacatgatttcttttacaaaatcatctttaaaatacagtatatttttagttttcataaaatatttaaagaaatgaaagtttataaacattcactcctattctctaattaaggatttgtaaaacaaaaattttgtaagcatatcgatttatgcgttttgtcttaattagctcactaaataataaataatagcttatgttgtgggactgtttaattacctaacttagaactaaaatcaactctttgtgacgcgtctacctagagtcagctgagcttagctaacgctagctagtgtcagctgacgttacgtaaggctaactagcgtcacgtgaccttacgtaacgctacgtaggctcagctgagcttagctaaccctagctagtgtcacgtgagcttacgctactatagaaaatgtgttatatcgacatgaccagacaaaggggcaacagttaacaaaacaattaattctttcatttgagattaaggaaggtaaggtactaaaaagattaaaaaaaatgagcttatctctttgtttctgtaataataatataagtgtgataaacttttaatataataattgtaattaggttttctacagatgagcaccactcagagacaagataagaagaaaacaattttgttaaacatgattatagaaacttttagttaagtcttgaagtatcaatataacaaaaaaaagtacacacgactatgacaataaacccactaccgtcaggttatcatttcgatgaaatgttttgatatcattaaatataacagtcacaaaaaatcatctaattataacaatataacttatacatatatttaactaaaaacttagagtttttgtaatgattctaattgatgattagagtttatagaaatacaattaaataaaaaatataattttaaaaaaacatagtaaagtcaatgagatcctctctgacctcagtgatcatttagtcatgtatgtacaacaatcattgttcatcacatgactgtaaaataaataaggataaacttgggaatatatataatatattgtattaaataaaaaagggaaatacaaatatcaattttagattcccgagttgacacaactcaccatgcacgctgccacctcagctcccagctctcgtcacatgtctcatgtcagttaggtctttggtttttagtctttgacacaactcgccatgcatgttgccacgtgagctcgttcctcttcccatgatctcaccactgggcatgcatgctgccacctcagctggcacctcttctctatatgtccctagaggccatgcacagtgccacctcagcactcctctcagaacccatacgtacctgccaatcggcttctctccataaatatctatttaaattataactaattatttcatatacttaattgatgacgtggatgcattgccatcgttgtttaataattgttaattacgacatgataaataaaatgaaagtaaaaagtacgaaagattttccatttgttgttgtataaatagagaagtgagtgatgcataatgcatgaatgcatgaccgcgccaccatgactgttggatacgacgaggagatcccattcgagcaagttagggctcataacaagccagacgacgcttggtgtgctattcacggacacgtgtacgacgttaccaagttcgcttcagttcacccaggaggagatattatcttgctcgctgctggaaaggaagctactgtcctctacgagacctaccatgttagaggagtgtctgacgctgtgctcagaaagtacagaataggaaagttgccagacggacaaggaggagctaacgagaaggagaagagaaccttgtctggattgtcctctgcttcttactacacctggaactccgatttctacagagtgatgagggagagagttgtggctagattgaaggagagaggaaaggctagaagaggaggatacgaactctggatcaaggctttcttgctccttgttggattctggtcctctctttactggatgtgcaccctcgatccatctttcggagctatcttggctgctatgtctttgggagtgttcgctgcttttgttggaacctgcatccaacacgatggaaaccacggagctttcgctcaatctagatgggttaacaaggtggcaggatggactttggatatgatcggagcttctggaatgacttgggagttccaacacgtgttgggacaccacccatacactaacttgatcgaggaggagaacggattgcaaaaggtgtccggaaagaagatggataccaagttggctgatcaagagtctgatccagatgtgttctccacctacccaatgatgagattgcacccttggcaccagaagaggtggtatcacaggttccagcacatctacggacctttcatcttcggattcatgaccatcaacaaggtggtgactcaagatgttggagtggtgttgagaaagagactcttccaaatcgatgctgagtgcagatatgcttccccaatgtacgttgctaggttctggattatgaaggctttgaccgtgttgtatatggttgctttgccttgttatatgcaaggaccttggcacggattgaaactcttcgctatcgctcacttcacttgcggagaggttttggctaccatgttcatcgtgaaccacattatcgagggagtgtcttacgcttctaaggatgctgttaagggaactatggctccaccaaagactatgcacggagtgaccccaatgaacaacactagaaaggaggttgaggctgaggcttctaagtctggagctgtggttaagtctgtgccattggatgattgggctgctgttcagtgccaaacctctgtgaactggtctgttggatcttggttttggaaccacttctctggaggactcaaccaccaaatcgagcaccacctcttcccaggattgtctcacgagacctactaccacatccaagacgtggttcaatctacctgtgctgagtacggagttccataccaacacgagccatctttgtggactgcttactggaagatgctcgaacaccttagacaattgggaaacgaggagactcacgagtcatggcagagagctgcttgattaatgaactaagactcccaaaaccaccttccctgtgacagttaaaccctgcttatacctttcctcctaataatgttcatctgtcacacaaactaaaataaataaaatgggagcaataaataaaatgggagctcatatatttacaccatttacactgtctattattcaccatgccaattattacttcataattttaaaattatgtcatttttaaaaattgcttaatgatggaaaggattattataagttaaaagtataacatagataaactaaccacaaaacaaatcaatataaactaacttactctcccatctaatttttatttaaatttctttacacttctcttccatttctatttctacaacattatttaacatttttattgtatttttcttactttctaactctattcatttcaaaaatcaatatatgtttatcaccacctctctaaaaaaaactttacaatcattggtccagaaaagttaaatcacgagatggtcattttagcattaaaacaacgattcttgtatcactatttttcagcatgtagtccattctcttcaaacaaagacagcggctatataatcgttgtgttatattcagtctaaaacaactacgtagcgtcacgtgacgttacctaagcctaggtagcctcagctgacgttacgtaacgctaggtaggctcagctgactgcagcaaatttacacattgccactaaacgtctaaacccttgtaatttgtttttgttttactatgtgtgttatgtatttgatttgcgataaatttttatatttggtactaaatttataacaccttttatgctaacgtttgccaacacttagcaatttgcaagttgattaattgattctaaattatttttgtcttctaaatacatatactaatcaactggaaatgtaaatatttgctaatatttctactataggagaattaaagtgagtgaatatggtaccacaaggtttggagatttaattgttgcaatgctgcatggatggcatatacaccaaacattcaataattcttgaggataataatggtaccacacaagatttgaggtgcatgaacgtcacgtggacaaaaggtttagtaatttttcaagacaacaatgttaccacacacaagttttgaggtgcatgcatggatgccctgtggaaagtttaaaaatattttggaaatgatttgcatggaagccatgtgtaaaaccatgacatccacttggaggatgcaataatgaagaaaactacaaatttacatgcaactagttatgcatgtagtctatataatgaggattttgcaatactttcattcatacacactcactaagttttacacgattataatttcttcatagccagtactgtttaagcttcactgtctctgaatcggcaaaggtaaacgtatcaattattctacaaacccttttatttttcttttgaattaccgtcttcattggttatatgataacttgataagtaaagcttcaataattgaatttgatctgtgtttttttggccttaatactaaatccttacataagctttgttgcttctcctcttgtgagttgagtgttaagttgtaataatggttcactttcagctttagaagaaacgcgccttccatggctacaaaggaggcttacgttttcccaactctcaccgagatcaagagatctctcccaaaggattgcttcgaggcttctgtgcctttgtctctctactacactgtgagatgcttggttattgctgtggctttgaccttcggattgaactacgctagagctttgccagaggttgagtctttctgggctttggatgctgctttgtgcactggatatatcctcctccagggaattgtgttctggggattcttcactgttggacacgatgctggacacggagctttctctagataccacctcttgaacttcgttgtgggaaccttcatgcactctctcatcttgaccccattcgagtcttggaagttgacccacagacaccaccacaagaacaccggaaacatcgatagagatgaggtgttctacccacagagaaaggctgatgatcacccattgtccaggaacttgatcttggctttgggagctgcttggcttgcttatttggtggagggattcccaccaagaaaggtgaaccacttcaacccattcgagccactttttgtgagacaagtgtccgctgtggttatctctttgctcgctcacttcttcgttgctggactctctatctacttgtctctccagttgggacttaagaccatggctatctactactacggaccagttttcgtgttcggatctatgttggtgattaccaccttcttgcaccacaacgatgaggagactccatggtatgctgattctgagtggacttacgtgaagggaaacttgtcctctgtggatagatcttacggtgctctcatcgataacctctcccacaacatcggaactcaccagatccaccacctcttcccaattatcccacactacaagctcaagaaggctactgctgctttccaccaagctttcccagagcttgtgagaaagtccgatgagccaatcatcaaggctttcttcagagtgggaaggttgtatgctaactacggagtggttgatcaagaggctaagctcttcactttgaaggaggctaaggctgctactgaagctgctgctaagaccaagtctacctgattaatgaatcgacaagctcgagtttctccataataatgtgtgagtagttcccagataagggaattagggttcctatagggtttcgctcatgtgttgagcatataagaaacccttagtatgtatttgtatttgtaaaatacttctatcaataaaatttctaattcctaaaaccaaaatccagtactaaaatccagatcccccgaattaattcggcgttaattcagctacgtaggctcagctgagcttacctaaggctacgtaggctcacgtgacgttacgtaaggctacgtagcgtcacgtgagcttacctaactctagctagcctcacgtgaccttagctaacactaggtagcgtcagcacagatgaatactagctgttgttcacagttctagtgtctcctcattacgtgaattcaagctacgatcactatctcaactcctacataaacatcagaatgctacaaaactatgcacaaaaacaaaagctacatctaatacgtgaatcaattactctcatcacaagaaagaagatttcaatcaccgtcgagaaggaggattcagttaattgaatcaaagttccgatcaaactcgaagactggtgagcacgaggacgacgaagaagagtgtctcgaagatacaacaagcaagaaatctactgagtgacctcctgaagttattggcgcgattgagagaatcaatccgaattaatttcggggaaaaagataaattagatactaagcgatgggcttgggctgggctaagaaacaggtggcaattgggctggaggaccccgcgattcatagcttccgatagcccaaaaaaaaacggataacatatttatcgggtatttgaatttcagtgaaataagatattttctttttgttaggaaaattttagaaaataatggaaattaaatagcgattatgttacaagatacgatcagcatcgggcagtgcaaaatgctatagcttcccaagatttgatccttttgggttatctcctaatgacaattagtttaggattttgaaacttatattaatactattatccgacaacacttgtttcagcttcttattttaacattttttgtttttttctattcttcttcccatcagcattttctttttaaaaaattgaatactttaactttttaaaaatttcacaatgatcagatgatattatggaagatctcaagagttaaatgtatccatcttggggcattaaaaccggtgtacgggatgataaatacagactttatatcatatgatagctcagtaattcatatttatcacgttgctaaaaaaattataaggtactagtagtcaacaaaatcaattaaagagaaagaaagaaacgcatgtgaagagagtttacaactggaaaagtaaaataaaaattaacgcatgttgaatgctgacatgtcagtatgtccatgaatccacgtatcaagcgccattcatcgatcgtcttcctctttctaaatgaaaacaacttcacacatcacaacaaacaatacacacaagaccccctctctctcgttgtctctctgccagcgaccaaatcgaagcttgagaagaacaagaaggggtcaaaccatgggaaaaggatctgagggaagatctgctgctagagagatgactgctgaggctaacggagataagagaaagaccatcctcattgagggagtgttgtacgatgctaccaacttcaaacacccaggaggttccattattaacttcctcaccgagggagaagctggagttgatgctacccaagcttacagagagttccatcagagatccggaaaggctgataagtacctcaagtccctcccaaagttggatgcttctaaggtggagtctaggttctctgctaaggagcaggctagaagggacgctatgaccagggattacgctgctttcagagaggagttggttgctgagggatacttcgatccatctatcccacacatgatctacagagtggtggagattgtggctttgttcgctttgtctttctggttgatgtctaaggcttctccaacctctttggttttgggagtggtgatgaacggaatcgctcaaggaagatgcggatgggttatgcacgagatgggacacggatctttcactggagttatctggctcgatgataggatgtgcgagttcttctacggagttggatgtggaatgtctggacactactggaagaaccagcactctaagcaccacgctgctccaaacagattggagcacgatgtggatttgaacaccttgccactcgttgctttcaacgagagagttgtgaggaaggttaagccaggatctttgttggctttgtggctcagagttcaggcttatttgttcgctccagtgtcttgcttgttgatcggattgggatggaccttgtacttgcacccaagatatatgctcaggaccaagagacacatggagtttgtgtggatcttcgctagatatatcggatggttctccttgatgggagctttgggatattctcctggaacttctgtgggaatgtacctctgctctttcggacttggatgcatctacatcttcctccaattcgctgtgtctcacacccacttgccagttaccaacccagaggatcaattgcactggcttgagtacgctgctgatcacaccgtgaacatctctaccaagtcttggttggttacctggtggatgtctaacctcaacttccaaatcgagcaccacttgttcccaaccgctccacaattcaggttcaaggagatctctccaagagttgaggctctcttcaagagacacaacctcccttactacgatttgccatacacctctgctgtttctactaccttcgctaacctctactctgttggacactctgttggagctgataccaagaagcaggattgatgattaatgaataattgattgtacatactatattttttgtttaccttgtgttagtttaatgttcagtgtcctctctttattgtggcacgtctctttgttgtatgttgtgtctatacaaagttgaaataatggaaagaaaaggaagagtgtaatttgttttgttttaagtgtttataaatatatatatataggtcatttagatagttctaggtttctataaaactctctctctggaagtagaatctgtttttgagaggatccagttgcctactaatctcccccaaaacccttcaagcttaaccttcctcttcacaacaacagaggaaacacatctcttgagctctgagttctcttctttgagcatgtctatcgctaaactcatctgccttatagcttccctcttctcttcatctctctctctcaccatttcgctgtaaaacttattctcctccctcagcctctctatctcttccttcagcatctcacaattcccaccataatcgactgaggatgattcaccgtcatcaacttcagactcagcgttgtagtcgtcatgagtctcacaagccttggaccaagaagactcatcatcgcaagttgatgatttatcatgatgcttctctgagccgtgtttgctagctagcctcagctgacgttacgtaacgctaggtagcgtcacgtgacgttagctaacgctaggtagcgtcagctgagcttacgtaagcgcacagatgaatactagctgttgttcacagttctagtgtctcctcattacgtgaattcaagctacgatcactatctcaactcctacataaacatcagaatgctacaaaactatgcacaaaaacaaaagctacatctaatacgtgaatcaattactctcatcacaagaaagaagatttcaatcaccgtcgagaaggaggattcagttaattgaatcaaagttccgatcaaactcgaagactggtgagcacgaggacgacgaagaagagtgtctcgaagatacaacaagcaagaaatctactgagtgacctcctgaagttattggcgcgattgagagaatcaatccgaattaatttcggggaaaaagataaattagatactaagcgatgggcttgggctgggctaagaaacaggtggcaattgggctggaggaccccgcgattcatagcttccgatagcccaaaaaaaaacggataacatatttatcgggtatttgaatttcagtgaaataagatattttctttttgttaggaaaattttagaaaataatggaaattaaatagcgattatgttacaagatacgatcagcatcgggcagtgcaaaatgctatagcttcccaagatttgatccttttgggttatctcctaatgacaattagtttaggattttgaaacttatattaatactattatccgacaacacttgtttcagcttcttattttaacattttttgtttttttctattcttcttcccatcagcattttctttttaaaaaattgaatactttaactttttaaaaatttcacaatgatcagatgatattatggaagatctcaagagttaaatgtatccatcttggggcattaaaaccggtgtacgggatgataaatacagactttatatcatatgatagctcagtaattcatatttatcacgttgctaaaaaaattataaggtactagtagtcaacaaaatcaattaaagagaaagaaagaaacgcatgtgaagagagtttacaactggaaaagtaaaataaaaattaacgcatgttgaatgctgacatgtcagtatgtccatgaatccacgtatcaagcgccattcatcgatcgtcttcctctttctaaatgaaaacaacttcacacatcacaacaaacaatacacacaagaccccctctctctcgttgtctctctgccagcgaccaaatcgaagcttgagaagaacaagaaggggtcaaaccatggcttctacatctgctgctcaagacgctgctccttacgagttcccttctctcactgagatcaagagggctcttccttctgagtgtttcgaggcttctgttcctctttctctctactacaccgctagatctcttgctcttgctggatctctcgctgttgctctctcttacgctagagctttgcctcttgttcaggctaacgctcttcttgatgctactctctgcactggatacgttcttctccagggaatcgttttctggggattcttcaccgttggtcacgattgtggacacggagctttctctagatctcacgtgctcaacttctctgttggaaccctcatgcactctatcatccttacccctttcgagtcttggaagctctctcacagacaccaccacaagaacaccggaaacatcgataaggacgagatcttctaccctcaaagagaggctgattctcaccctgtttctagacaccttgtgatgtctcttggatctgcttggttcgcttaccttttcgctggattccctcctagaaccatgaaccacttcaacccttgggaggctatgtatgttagaagagtggctgctgtgatcatctctctcggagttcttttcgctttcgctggactctactcttacctcaccttcgttcttggattcaccactatggctatctactacttcggacctctcttcatcttcgctaccatgcttgttgttaccactttcctccaccacaacgatgaggagacaccttggtacgctgattctgagtggacttacgtgaagggaaacctctcttctgtggacagatcttacggtgctctcatcgacaaccttagccacaacatcggaactcaccagatccaccacctcttccctatcatccctcactacaagctcaacgatgctactgctgctttcgctaaggctttccctgagcttgttaggaaaaacgctgctcctatcatcccaactttcttcaggatggctgctatgtacgctaagtacggagttgttgacactgatgctaagaccttcactctcaaggaggctaaggctgctgctaagactaagtcatcttgatgattaatgaataattgattgtacatactatattttttgtttaccttgtgttagtttaatgttcagtgtcctctctttattgtggcacgtctctttgttgtatgttgtgtctatacaaagttgaaataatggaaagaaaaggaagagtgtaatttgttttgttttaagtgtttataaatatatatatataggtcatttagatagttctaggtttctataaaactctctctctggaagtagaatctgtttttgagaggatccagttgcctactaatctcccccaaaacccttcaagcttaaccttcctcttcacaacaacagaggaaacacatctcttgagctctgagttctcttctttgagcatgtctatcgctaaactcatctgccttatagcttccctcttctcttcatctctctctctcaccatttcgctgtaaaacttattctcctccctcagcctctctatctcttccttcagcatctcacaattcccaccataatcgactgaggatgattcaccgtcatcaacttcagactcagcgttgtagtcgtcatgagtctcacaagccttggaccaagaagactcatcatcgcaagttgatgatttatcatgatgcttctctgagccgtgtttgctagctagcctcagctgacgttacgtaacgctaggtagcgtcacgtgacgttagctaacgctaggtagcgtcagctgagcttacgtaagcgcttaattaaagtactgatatcggtaccaaatcgaatccaaaaattacggatatgaatataggcatatccgtatccgaattatccgtttgacagctagcaacgattgtacaattgcttctttaaaaaaggaagaaagaaagaaagaaaagaatcaacatcagcgttaacaaacggccccgttacggcccaaacggtcatatagagtaacggcgttaagcgttgaaagactcctatcgaaatacgtaaccgcaaacgtgtcatagtcagatcccctcttccttcaccgcctcaaacacaaaaataatcttctacagcctatatatacaacccccccttctatctctcctttctcacaattcatcatctttctttctctacccccaattttaagaaatcctctcttctcctcttcattttcaaggtaaatctctctctctctctctctctctgttattccttgttttaattaggtatgtattattgctagtttgttaatctgcttatcttatgtatgccttatgtgaatatctttatcttgttcatctcatccgtttagaagctataaatttgttgatttgactgtgtatctacacgtggttatgtttatatctaatcagatatgaatttcttcatattgttgcgtttgtgtgtaccaatccgaaatcgttgatttttttcatttaatcgtgtagctaattgtacgtatacatatggatctacgtatcaattgttcatctgtttgtgtttgtatgtatacagatctgaaaacatcacttctctcatctgattgtgttgttacatacatagatatagatctgttatatcattttttttattaattgtgtatatatatatgtgcatagatctggattacatgattgtgattatttacatgattttgttatttacgtatgtatatatgtagatctggactttttggagttgttgacttgattgtatttgtgtgtgtatatgtgtgttctgatcttgatatgttatgtatgtgcagctgaaccatggcggcggcaacaacaacaacaacaacatcttcttcgatctccttctccaccaaaccatctccttcctcctccaaatcaccattaccaatctccagattctccctcccattctccctaaaccccaacaaatcatcctcctcctcccgccgccgcggtatcaaatccagctctccctcctccatctccgccgtgctcaacacaaccaccaatgtcacaaccactccctctccaaccaaacctaccaaacccgaaacattcatctcccgattcgctccagatcaaccccgcaaaggcgctgatatcctcgtcgaggctttagaacgtcaaggcgtagaaaccgtattcgcttaccctggaggtacatcaatggagattcaccaagccttaacccgctcttcctcaatccgtaacgtccttcctcgtcacgaacaaggaggtgtattcgcagcagaaggatacgctcgatcctcaggtaaaccaggtatctgtatagccacttcaggtcccggagctacaaatctcgttagcggattagccgatgcgttgttagatagtgttcctcttgtagcaatcacaggacaagtccctcgtcgtatgattggtacagatgcgtttcaagagactccgattgttgaggtaacgcgttcgattacgaagcataactatcttgtgatggatgttgaagatatcccaaggattattgaagaggctttctttttagctacttctggtagacctggacctgttttggttgatgttcctaaagatattcaacaacagcttgcgattcctaattgggaacaggctatgagattacctggttatatgtctaggatgcctaaacctccggaagattctcatttggagcagattgttaggttgatttctgagtctaagaagcctgtgttgtatgttggtggtggttgtcttaattctagcgatgaattgggtaggtttgttgagcttacgggcatccctgttgcgagtacgttgatggggctgggatcttatccttgtgatgatgagttgtcgttacatatgcttggaatgcatgggactgtgtatgcaaattacgctgtggagcatagtgatttgttgttggcgtttggggtaaggtttgatgatcgtgtcacgggtaaacttgaggcttttgctagtagggctaagattgttcatattgatattgactcggctgagattgggaagaataagactcctcatgtgtctgtgtgtggtgatgttaagctggctttgcaagggatgaataaggttcttgagaaccgagcggaggagcttaaacttgattttggagtttggaggaatgagttgaacgtacagaaacagaagtttccgttgagctttaagacgtttggggaagctattcctccacagtatgcgattaaggtccttgatgagttgactgatggaaaagccataataagtactggtgtcgggcaacatcaaatgtgggcggcgcagttctacaattacaagaaaccaaggcagtggctatcatcaggaggccttggagctatgggatttggacttcctgctgcgattggagcgtctgttgctaaccctgatgcgatagttgtggatattgacggagatggaagttttataatgaatgtgcaagagctagccactattcgtgtagagaatcttccagtgaaggtacttttattaaacaaccagcatcttggcatggttatgcaatgggaagatcggttctacaaagctaaccgagctcacacatttctcggggacccggctcaggaggacgagatattcccgaacatgttgctgtttgcagcagcttgcgggattccagcggcgagggtgacaaagaaagcagatctccgagaagctattcagacaatgctggatacaccaggaccttacctgttggatgtgatttgtccgcaccaagaacatgtgttgccgatgatcccgaatggtggcactttcaacgatgtcataacggaaggagatggccggattaaatactgagagatgaaaccggtgattatcagaaccttttatggtctttgtatgcatatggtaaaaaaacttagtttgcaatttcctgtttgttttggtaatttgagtttcttttagttgttgatctgcctgctttttggtttacgtcagactactactgctgttgttgtttggtttcctttctttcattttataaataaataatccggttcggtttactccttgtgactggctcagtttggttattgcgaaatgcgaatggtaaattgagtaattgaaattcgttattagggttctaagctgttttaacagtcactgggttaatatctctcgaatcttgcatggaaaatgctcttaccattggtttttaattgaaatgtgctcatatgggccgtggtttccaaattaaataaaactacgatgtcatcgagaagtaaaatcaactgtgtccacattatcagttttgtgtatacgatgaaatagggtaattcaaaatctagcttgatatgccttttggttcattttaaccttctgtaaacattttttcagattttgaacaagtaaatccaaaaaaaaaaaaaaaaatctcaactcaacactaaattattttaatgtataaaagatgcttaaaacatttggcttaaaagaaagaagctaaaaacatagagaactcttgtaaattgaagtatgaaaatatactgaattgggtattatatgaatttttctgatttaggattcacatgatccaaaaaggaaatccagaagcactaatcagacattggaagtaggattaatcagtgatcagtaactattaaattcaattaaccgcggacatctacatttttgaattgaaaaaaaattggtaattactctttctttttctccatattgaccatcatactcattgctgatccatgtagatttcccggacatgaagccatttacaattgaatatatcctgccgccgctgccgctttgcacccggtggagcttgcatgttggtttctacgcagaactgagccggttaggcagataatttccattgagaactgagccatgtgcaccttccccccaacacggtgagcgacggggcaacggagtgatccacatgggacttttaaacatcatccgtcggatggcgttgcgagagaagcagtcgatccgtgagatcagtcgaccaattctcatgtttgacagcttatcatcgaatttctgccattcatccgcttattatcacttattcaggcgtagcaaccaggcgtttaagggcaccaataactgccttaaaaaaattacgccccgccctgccactcatcgcagtactgttgtaattcattaagcattctgccgacatggaagccatcacaaacggcatgatgaacctgaatcgccagcggcatcagcaccttgtcgccttgcgtataatatttgcccatggtgaaaacgggggcgaagaagttgtccatattggccacgtttaaatcaaaactggtgaaactcacccagggattggctgagacgaaaaacatattctcaataaaccctttagggaaataggccaggttttcaccgtaacacgccacatcttgcgaatatatgtgtagaaactgccggaaatcgtcgtggtattcactccagagcgatgaaaacgtttcagtttgctcatggaaaacggtgtaacaagggtgaacactatcccatatcaccagctcaccgtctttcattgccatacggaattccggatgagcattcatcaggcgggcaagaatgtgaataaaggccggataaaacttgtgcttatttttctttacggtctttaaaaaggccgtaatatccaggacctgcaggggggggggggcgctgaggtctgcctcgtgaagaaggtgttgctgactcataccaggcctgaatcgccccatcatccagccagaaagtgagggagccacggttgatgagagctttgttgtaggtggaccagttggtgattttgaacttttgctttgccacggaacggtctgcgttgtcgggaagatgcgtgatctgatccttcaactcagcaaaagttcgatttattcaacaaagccgccgtcccgtcaagtcagcgtaatgctctgccagtgttacaaccaattaaccaattctgattagaaaaactcatcgagcatcaaatgaaactgcaatttattcatatcaggattatcaataccatatttttgaaaaagccgtttctgtaatgaaggagaaaactcaccgaggcagttccataggatggcaagatcctggtatcggtctgcgattccgactcgtccaacatcaatacaacctattaatttcccctcgtcaaaaataaggttatcaagtgagaaatcaccatgagtgacgactgaatccggtgagaatggcaaaagcttatgcatttctttccagacttgttcaacaggccagccattacgctcgtcatcaaaatcactcgcatcaaccaaaccgttattcattcgtgattgcgcctgagcgagacgaaatacgcgatcgctgttaaaaggacaattacaaacaggaatcgaatgcaaccggcgcaggaacactgccagcgcatcaacaatattttcacctgaatcaggatattcttctaatacctggaatgctgttttcccggggatcgcagtggtgagtaaccatgcatcatcaggagtacggataaaatgcttgatggtcggaagaggcataaattccgtcagccagtttagtctgaccatctcatctgtaacatcattggcaacgctacctttgccatgtttcagaaacaactctggcgcatcgggcttcccatacaatcgatagattgtcgcacctgattgcccgacattatcgcgagcccatttatacccatataaatcagcatccatgttggaatttaatcgcggcctcgagcaagacgtttcccgttgaatatggctcataacaccccttgtattactgtttatgtaagcagacagttttattgttcatgatgatatatttttatcttgtgcaatgtaacatcagagattttgagacacaacgtggctttcccccccccccctgcaggtcctgaacggtctggttataggtacattgagcaactgactgaaatgcctcaaaatgttctttacgatgccattgggatatatcaacggtggtatatccagtgatttttttctccattttagcttccttagctcctgaaaatctcgataactcaaaaaatacgcccggtagtgatcttatttcattatggtgaaagttggaacctcttacgtgccgatcaacgtctcattttcgccaaaagttggcccagggcttcccggtatcaacagggacaccaggatttatttattctgcgaagtgatcttccgtcacaggtatttattcgcgataagctcatggagcggcgtaaccgtcgcacaggaaggacagagaaagcgcggatctgggaagtgacggacagaacggtcaggacctggattggggaggcggttgccgccgctgctgctgacggtgtgacgttctctgttccggtcacaccacatacgttccgccattcctatgcgatgcacatgctgtatgccggtataccgctgaaagttctgcaaagcctgatgggacataagtccatcagttcaacggaagtctacacgaaggtttttgcgctggatgtggctgcccggcaccgggtgcagtttgcgatgccggagtctgatgcggttgcgatgctgaaacaattatcctgagaataaatgccttggcctttatatggaaatgtggaactgagtggatatgctgtttttgtctgttaaacagagaagctggctgttatccactgagaagcgaacgaaacagtcgggaaaatctcccattatcgtagagatccgcattattaatctcaggagcctgtgtagcgtttataggaagtagtgttctgtcatgatgcctgcaagcggtaacgaaaacgatttgaatatgccttcaggaacaatagaaatcttcgtgcggtgttacgttgaagtggagcggattatgtcagcaatggacagaacaacctaatgaacacagaaccatgatgtggtctgtccttttacagccagtagtgctcgccgcagtcgagcgacagggcgaagccctcgagtgagcgaggaagcaccagggaacagcacttatatattctgcttacacacgatgcctgaaaaaacttcccttggggttatccacttatccacggggatatttttataattattttttttatagtttttagatcttcttttttagagcgccttgtaggcctttatccatgctggttctagagaaggtgttgtgacaaattgccctttcagtgtgacaaatcaccctcaaatgacagtcctgtctgtgacaaattgcccttaaccctgtgacaaattgccctcagaagaagctgttttttcacaaagttatccctgcttattgactcttttttatttagtgtgacaatctaaaaacttgtcacacttcacatggatctgtcatggcggaaacagcggttatcaatcacaagaaacgtaaaaatagcccgcgaatcgtccagtcaaacgacctcactgaggcggcatatagtctctcccgggatcaaaaacgtatgctgtatctgttcgttgaccagatcagaaaatctgatggcaccctacaggaacatgacggtatctgcgagatccatgttgctaaatatgctgaaatattcggattgacctctgcggaagccagtaaggatatacggcaggcattgaagagtttcgcggggaaggaagtggttttttatcgccctgaagaggatgccggcgatgaaaaaggctatgaatcttttccttggtttatcaaacgtgcgcacagtccatccagagggctttacagtgtacatatcaacccatatctcattcccttctttatcgggttacagaaccggtttacgcagtttcggcttagtgaaacaaaagaaatcaccaatccgtatgccatgcgtttatacgaatccctgtgtcagtatcgtaagccggatggctcaggcatcgtctctctgaaaatcgactggatcatagagcgttaccagctgcctcaaagttaccagcgtatgcctgacttccgccgccgcttcctgcaggtctgtgttaatgagatcaacagcagaactccaatgcgcctctcatacattgagaaaaagaaaggccgccagacgactcatatcgtattttccttccgcgatatcacttccatgacgacaggatagtctgagggttatctgtcacagatttgagggtggttcgtcacatttgttctgacctactgagggtaatttgtcacagttttgctgtttccttcagcctgcatggattttctcatactttttgaactgtaatttttaaggaagccaaatttgagggcagtttgtcacagttgatttccttctctttcccttcgtcatgtgacctgatatcgggggttagttcgtcatcattgatgagggttgattatcacagtttattactctgaattggctatccgcgtgtgtacctctacctggagtttttcccacggtggatatttcttcttgcgctgagcgtaagagctatctgacagaacagttcttctttgcttcctcgccagttcgctcgctatgctcggttacacggctgcggcgagcgctagtgataataagtgactgaggtatgtgctcttcttatctccttttgtagtgttgctcttattttaaacaactttgcggttttttgatgactttgcgattttgttgttgctttgcagtaaattgcaagatttaataaaaaaacgcaaagcaatgattaaaggatgttcagaatgaaactcatggaaacacttaaccagtgcataaacgctggtcatgaaatgacgaaggctatcgccattgcacagtttaatgatgacagcccggaagcgaggaaaataacccggcgctggagaataggtgaagcagcggatttagttggggtttcttctcaggctatcagagatgccgagaaagcagggcgactaccgcacccggatatggaaattcgaggacgggttgagcaacgtgttggttatacaattgaacaaattaatcatatgcgtgatgtgtttggtacgcgattgcgacgtgctgaagacgtatttccaccggtgatcggggttgctgcccataaaggtggcgtttacaaaacctcagtttctgttcatcttgctcaggatctggctctgaaggggctacgtgttttgctcgtggaaggtaacgacccccagggaacagcctcaatgtatcacggatgggtaccagatcttcatattcatgcagaagacactctcctgcctttctatcttggggaaaaggacgatgtcacttatgcaataaagcccacttgctggccggggcttgacattattccttcctgtctggctctgcaccgtattgaaactgagttaatgggcaaatttgatgaaggtaaactgcccaccgatccacacctgatgctccgactggccattgaaactgttgctcatgactatgatgtcatagttattgacagcgcgcctaacctgggtatcggcacgattaatgtcgtatgtgctgctgatgtgctgattgttcccacgcctgctgagttgtttgactacacctccgcactgcagtttttcgatatgcttcgtgatctgctcaagaacgttgatcttaaagggttcgagcctgatgtacgtattttgcttaccaaatacagcaatagtaatggctctcagtccccgtggatggaggagcaaattcgggatgcctggggaagcatggttctaaaaaatgttgtacgtgaaacggatgaagttggtaaaggtcagatccggatgagaactgtttttgaacaggccattgatcaacgctcttcaactggtgcctggagaaatgctctttctatttgggaacctgtctgcaatgaaattttcgatcgtctgattaaaccacgctgggagattagataatgaagcgtgcgcctgttattccaaaacatacgctcaatactcaaccggttgaagatacttcgttatcgacaccagctgccccgatggtggattcgttaattgcgcgcgtaggagtaatggctcgcggtaatgccattactttgcctgtatgtggtcgggatgtgaagtttactcttgaagtgctccggggtgatagtgttgagaagacctctcgggtatggtcaggtaatgaacgtgaccaggagctgcttactgaggacgcactggatgatctcatcccttcttttctactgactggtcaacagacaccggcgttcggtcgaagagtatctggtgtcatagaaattgccgatgggagtcgccgtcgtaaagctgctgcacttaccgaaagtgattatcgtgttctggttggcgagctggatgatgagcagatggctgcattatccagattgggtaacgattatcgcccaacaagtgcttatgaacgtggtcagcgttatgcaagccgattgcagaatgaatttgctggaaatatttctgcgctggctgatgcggaaaatatttcacgtaagattattacccgctgtatcaacaccgccaaattgcctaaatcagttgttgctcttttttctcaccccggtgaactatctgcccggtcaggtgatgcacttcaaaaagcctttacagataaagaggaattacttaagcagcaggcatctaaccttcatgagcagaaaaaagctggggtgatatttgaagctgaagaagttatcactcttttaacttctgtgcttaaaacgtcatctgcatcaagaactagtttaagctcacgacatcagtttgctcctggagcgacagtattgtataagggcgataaaatggtgcttaacctggacaggtctcgtgttccaactgagtgtatagagaaaattgaggccattcttaaggaacttgaaaagccagcaccctgatgcgaccacgttttagtctacgtttatctgtctttacttaatgtcctttgttacaggccagaaagcataactggcctgaatattctctctgggcccactgttccacttgtatcgtcggtctgataatcagactgggaccacggtcccactcgtatcgtcggtctgattattagtctgggaccacggtcccactcgtatcgtcggtctgattattagtctgggaccacggtcccactcgtatcgtcggtctgataatcagactgggaccacggtcccactcgtatcgtcggtctgattattagtctgggaccatggtcccactcgtatcgtcggtctgattattagtctgggaccacggtcccactcgtatcgtcggtctgattattagtctggaaccacggtcccactcgtatcgtcggtctgattattagtctgggaccacggtcccactcgtatcgtcggtctgattattagtctgggaccacgatcccactcgtgttgtcggtctgattatcggtctgggaccacggtcccacttgtattgtcgatcagactatcagcgtgagactacgattccatcaatgcctgtcaagggcaagtattgacatgtcgtcgtaacctgtagaacggagtaacctcggtgtgcggttgtatgcctgctgtggattgctgctgtgtcctgcttatccacaacattttgcgcacggttatgtggacaaaatacctggttacccaggccgtgccggcacgtttcctacaaggtagaatccgcctgagtcgcaagggtgacttcgcctatattggacgacggcgcgcagagggcgacctctttttgggttacgattgtaggattatcactaaaacaatacatgaacatattcaaatggcaatctctctaaggcattggaaataaatacaaataacagttgggtggagtttttcgacctgagggcgttaactcttcaaggacaacaagaccgtggacgtcgagcggctctccgacaagcatgtcgcccgcctggtcaagcagaccgcactcgccgccggcgcttcgataccgttcgtattggtccggcgaaactgtgagtatccgcatcgtaatctccgcatgaacaggtcatgcgaacagaaatcatctcacggtgcgtttgcctacgtgcagatttgcacctcaggtgattctaccgagtcggtgttccaaggcgcgaaatgcgagcgggtgaggccgaccagacgccgacaaggttgtgcagatctgcacttggtgccacgtcgcacagaagaagggaatcggtctaactcacagatagcatttgaagaatcgggatttagtgtgatttcgattgaaacgcgcgtaaccgttcattaaccaaaaacgtcttgcaacctcacccgcattaggtaatcgtcacggataaatggcaatacgcgccaattaaccgtgacaagagataacaccgtgagcaaagccgctgccatatcccgaaatgatcgcccgtcggtagatgttaccattggtgagcatgctgagcagctcagctctcagcttcaagcgatgagcgaggctttgtttcctccgacgtcgcacaagagcttgcgcaaattcacctcgggtgaagccgcacgcttgatgaaaatatctgactcaactcttcgaaagatgacactggctggcgaagggccgcaacctgaactcgccagcaacggacggcgcttttacaccctcggtcagataaacgaaatccggcagatgcttgccggctcgactcgaggacgtgaaagcattgattttgtgcctcatcgccgaggttctgagcatttgcaagtcgttgctgtaaccaacttcaaaggtggctctgggaagacgacgacgtccgctcatcttgcacagtatctggcgttgcaaggttacagggttctcgcagtcgatctcgatccgcaggctagtctttcagcactcctcggcgttctgccagaaactgatgtcggtgcaaacgaaacgctctatgcggctattcggtacgacgacacacgtcgtccgttgcgagatgtgatccgaccgacgtattttgatggtcttcaccttgttcctggaaatctcgagcttatggagttcgagcataccaccccgaaagcattgactgacaaaggtacgcgcgacggattgttcttcactcgcgtggcccaagcctttgatgaggtcgccgacgattacgatgtcgtggtcatcgactgccctcctcagcttgggtttttgactctcagcgggttgtgtgctgcaacatcaatggtaatcaccgtacatcctcagatgctggatatcgcttccatgagccagtttctcctcatgacacgcgaccttctgggtgtcgtgaaagaggcggggggcaatctccagtacgatttcatacgctatctcttgacgcgctatgagccccaggacgcgccgcagacgaaagtgacggcactgctgcgcaacatgttcgaggatcacgtccttacaaatcctatggtcaagtcggcagcggtatctgatgccggtttaaccaagcagacgctctatgagatagggcgagagaaccttacgcgatcgacatacgaccgggcgatggaatctttagatgcggtgaattcggagatcgaggctttgatcaagatggcgtgggggcgggtctaatgaaaggctttgcgttcctcacagatctgttgggagctcccaacagacaggtgttgattcgccccctggacatggggcactggagaagccggggtaatttgagacgacgacgcacgcccatcgctaattggccagggtgcagttgtcttgtcttgttgggagctcccaaccaagcgcatttgcaatcaaaaatgcgacgccacgacgccaaacccaagaggccgatatcatgagccgcaaagacgcaatcgatactttgttcctcaagaagcaacctgcgaccgatagagcagcagtcgacaagtcgaccgctcgtgttcgtaccggagcgatttcggccatgggttcgtctttgcaagagatggctgagggcgcaaaggctgcagctcggctgcaggatcaactggctacaggcgaagccgtcgtgtccctggatccatccatgatcgacgggtcgccgatcgcggatcggctgccctcagacgtggatccgaaattcgagcagcttgaggcgagcatttcgcaggaggggcagcaggtgccggttcttgtcagaccgcaccctgaggctgccggtcgatatcagatcgtatatggaaggcggcggctgcgcgcggcagtaaatctgcggagagaggtttctgccattgttcgaaatctcacggactgtgaactggtcgtggcccagggccgcgaaaatcttaaccgcgctgacctctcgttcattgagaaggctctcttcgccctgcgcctcgaagatgcgggttttgatagagccaccatcattgccgcgctatccactgacaaggccgacctcagccgctacataactgtagcaaggggcataccgctgaacctcgccacacaaatcggcccagcgtcgaaagcgggtcgatcgcgttgggtcgtacttgccgaggggcttgggaagcctaaggcaacggacgcaatcgaagcgatgcttgggtcagagcagttcaagcaatctgatagcgatacccgctttaacctcattttcaacgccgtttcaaggccacctgcgaagactccaaaaaaggtaagggcctggagcacgccaaaggggaaaaaggcagcgacgatccgacaagaaactggacgaacggcgctggttttcgacgagagactggtgccaacttttggcgaatatgtcgctgaccagttggacagtctgtacgcccagttcattgaaaccaacggaggaggcaagctcgaccaatagtcagggtttcatccaatttaaagctccgctcgactgagatggactggctctcaccgcaaaagaaaaaggcccccgaaacggcgttccggaagaccttctctgtagtctcgcagctaagagaatcgcatttccaggaatcgtagtcaagggtcccgtaagggaaagcgtcatttcgacgggcggatttcaattgcctaacaaaaggtaaaaggaaatgcagacgcatatctcaacgacgtcctttgggcggcggccgatgacactcggccatattgcaagccagatggcagcaaaagcggtcgcatcagacactgtcgcccacaaatggcaggtcttccagcacatccgtgaatcccggggactgatcggagccacggaccgctcactctcgatcctgaacgcgctgttgacgttttacccggagaccgccttgactggtggtgccgaactggtcgtatggccttctaacgaacagctgatggctcgcgccaacggcatgcccgccacgacactgcgccggcatcttgccatactggttgattgcgggctcatcattcgccgcgacagccccaatggcaagcggttcgcccgcaagggaaggggaggggagattgagcaggcctatgggttcgatctgtcgccgatcgtcgcgcgggccgaggagttccgagatctggcccagacagtgcaagctgaaaaaaaggccttccgggtggccaaggagcgcttgactcttcttcgtcgtgacattgtcaaaatgatcgaaactggcgtcgaagagagcgttcctggaaactggggaagagttacccagacctatcaggggatcatcggccgcctgccacgctcggcacctcggcagcttgtcgagagtattgggcaagagcttcaggaactctgcatcgagatccgtgacgtattggaatctttcacaaaaacgatgaatctggacgccaatgagtcccatatcggtcgccacaaacagaattcaaatccagactctaaatttgaatctgaatacagctctggaaaaaaagatgaagcgggcggcagcgttgcggaaaccgacaatgtacggagcttgccgaaacgcgagctgcctttgggaatcgtgctggatgcctgccccgaaatgcgggaattggcccagggaggtccaattcggcattggcgcgacttgctggcggcggctgagcttgcccggccgatgctggggattagtccgagcgcctggcgggaggcccgcgaaaccatgggcgatcaacacgcggcgatcacgctggcttcgatctatcagcgggccggtcagatcaataacgctgggggctatctgcgcagcctgaccgaccgggccaaggatgggaagttttcgacctggccgatggtcatggcgttgctccgggcaaagctggacgagcagaagaatgcagttggcgctggaaagccgcgaactgctgaggaggtcgaggatgacagccgcctccacgtatcggaatcgctgctcaaaaacctgcgaaagccgagatcttggtgatcctctcgctattcagccgcggcgatgtcgacgtcggtgatcaacccggaacgtcgggcgcggtcgatcaggttcttgacggacgagggcgcccatttggatccaccgcgcggcgtgcgctcgtgcagtctttcaagctggccggcgatctcgcggagcttcaggtctgggttcgaagaatggatgccggccacaagcgtcatcaggcgatcttcgggaagacggggaggagattttttcaggagcgctgcatccaccaggcgttccgtcaccatccacttcacggctcggcgaagacgttctggcgtccagtcgaggccccgctgcttgagcattcgggcgatgtcgtcccatgtgtgatccggtcgcatgcgacgaacggtaggaagccattggttcgcggacgcctgaatcctatcgccatatgccgctttctgggccgcggtcatccttgccagcgcctccgggcgcttttcccggatgcccgggttgccggaaagcttccctaggcacaaacgttgactcttggatcgagctggcagacaaagcaataacccacacagaggacgattaatggctgacgaagagatccagaatccgccggacggtactgctgctgccgaagttgagccggctgctcctagaggtagaagagcaaagaaagcaccagccgaaacagcccgcacgggatcgttcaaatccgtgaagccgaaaacccgcggcctcagcaaccgagaaaaactggagaagatcggtcaaatcgaagctcaggtcgctggcggcgcaaccttgaaggacgccgttaagatcgtgggtatttccgttcagacctattatcaatggaagagagctgcggttcaacctgtctcacagaatccggccgtgtctgtttcagttgacgatgaactcggcgagttcatccaactcgaggaggaaaatcggcggctcagaaagcttcacgctgccgcaagcactcagggcgcaagggctgctaaaggaagcggaacacgtagaaagccagtccgcagaaacggtgctgaccccggatgaatgtcagctactgggctatctggacaagggaaaacgcaagcgcaaagagaaagcaggtagcttgcagtgggcttacatggcgatagctagactgggcggttttatggacagcaagcgaaccggaattgccagctggggcgccctctgggaaggttgggaagccctgcaaagtaaactggatggctttcttgccgccaaggatctgatggcgcaggggatcaagatctgatcaagagacaggggccggcccacgctgtcgtccaatctcccaagacacgccgccaccgcgcaccgtcgcggcgagctgctccccaagccgctgttcgatgggcttccaccgcacgaggctggaccccttggcgtcatcaagcatcccatttcgcccgctggcgagcatgacggggcgccggtagacgccggcaacgcgctggccgtcggccacggggcgatgctccaggccggtatcggcggcaatgtccttcgcggcctgcgccagttcccgagcccgctgctgcccagcagattccggtgaggatcacgcgctgcccgcgccgctcggccagtccctgttcggccaggaagtccgcgcgctgctgtatcgcctacttggcctcactgctaaagcccaggtcgcccaagcccgagccaccgtcgatcaactgctggtcaagccaggtggcaccgatcacgcgggcctgccgctcgatgggcaggtgcgatttcagctccaccgtcacgccaccaagacgctgggcgtcatagcggcggccctgctcgggcagatcgtccggcaccttccatagtccctcggccacgcacaccacgatgccggcctggtgcagggcttcgaggcggcgggtgtggcccgcaacgacttccagcggatcacgcccgacacggcctgacctagctcgacgaccaggtgagatcggtgaccgcgctagtcaagcaaccggcgtgccatggcgtttacggccagatcaatcgcagcgccctcgccctcgccgtcgccgtcgccgatgaaccaggctgccgacaagcccgtccatgcaatgatccagcgaagaagccgttcgggctcaaacccggtcgtcgcgaccacaatgctgagtcgagcctccagcctgcccggcaggatcgcaagcgggcgaccggggtcgctgagatcgggattcgtgaagatgttggcatagtcgaaggtgcgctcgccgagcagtccgtgcgggtcgatggccagccagccgcggtcgccgaagtcgagcacgttctcgtggtgcaggtcgccgtggagcgggcacacctcgcgcggcgccgccagaagttggcgcgctacgctggcggcgggcgcaagtgccgcgtgctcagcggccaaccggaaaagcggctggaaccattcctgtagcggatggagatcgggcggcggtccggaccgcggcgcgtgcagacgagcggcggtgtcgcagaggatcgtggcatcaccgaaccgcgccgtgcgcgggtcgtcggtgagccagagtttcagcaggccgcccaggcggcccaggtcgccattgatgcgggccagctcgcggacgtgctcatagtccacgacgcccgtgattttgtagccctggccgacggccagcaggtaggccgacaggctcatgccggccgccgccgccttttcctcaatcgctcttcgttcgtctggaaggcagtacaccttgataggtgggctgcccttcctggttggcttggtttcatcagccatccgcttgccctcatctgttacgccggcggtagccggccagcctcgcagagcaggattcccgttgagcaccgccaggtgcgaataagggacagtgaagaaggaacacccgctcgcgggtgggcctacttcacctatcctgcccggctgacgccgttggatacaccaaggaaagtctacacgaaccctttggcaaaatcctgtatatcgtgcgaaaaaggatggatataccgaaaaaatcgctataatgaccccgaagcagggttatgcagcggaaaagcgctgcttccctgctgttttgtggaatatctaccgactggaaacaggcaaatgcaggaaattactgaactgaggggacaggcgagagacgatgccaaagagctacaccgacgagctggccgagtgggttgaatcccgcgcggccaagaagcgccggcgtgatgaggctgcggttgcgttcctggcggtgagggcggatgtcgaggcggcgttagcgtccggctatgcgctcgtcaccatttgggagcacatgcgggaaacggggaaggtcaagttctcctacgagacgttccgctcgcacgccaggcggcacatcaaggccaagcccgccgatgtgcccgcaccgcaggccaaggctgcggaacccgcgccggcacccaagacgccggagccacggcggccgaagcaggggggcaaggctgaaaagccggcccccgctgcggccccgaccggcttcaccttcaacccaacaccggacaaaaaggatcaaccgggctgcatccgatgcaagtgtgtcgctgtcgactcgttgtacaacgaaatccattcccattccgcgctcaagatggcttcccctcggcagttcatcagggctaaatcaatctagccgacttgtccggtgaaatgggctgcactccaacagaaacaatcaaacaaacatacacagcgacttattcacacgagctcaaattacaacggtatatat

SEQ ID NO: 2 - DNA, 61102 bp, Artificial Sequence
  plasmid
cctgccagtcagcatcatcacaccaaaagttaggcccgaatagtttgaaattagaaagctcgcaattgaggtctacaggccaaattcgctcttagccgtacaatattactcaccggtgcgatgccccccatcgtaggtgaaggtggaaattaatggcgcgcctgatcactgattagtaactattacgtaagcctacgtagcgtcacgtgacgttagctaacgctacgtagcctcagctgacgttacgtaagcctacgtagcgtcacgtgagcttagctaacgctacctaggctcagctgacgttacgtaacgctagctagcgtcactcctgcagcaaatttacacattgccactaaacgtctaaacccttgtaatttgtttttgttttactatgtgtgttatgtatttgatttgcgataaatttttatatttggtactaaatttataacaccttttatgctaacgtttgccaacacttagcaatttgcaagttgattaattgattctaaattatttttgtcttctaaatacatatactaatcaactggaaatgtaaatatttgctaatatttctactataggagaattaaagtgagtgaatatggtaccacaaggtttggagatttaattgttgcaatgctgcatggatggcatatacaccaaacattcaataattcttgaggataataatggtaccacacaagatttgaggtgcatgaacgtcacgtggacaaaaggtttagtaatttttcaagacaacaatgttaccacacacaagttttgaggtgcatgcatggatgccctgtggaaagtttaaaaatattttggaaatgatttgcatggaagccatgtgtaaaaccatgacatccacttggaggatgcaataatgaagaaaactacaaatttacatgcaactagttatgcatgtagtctatataatgaggattttgcaatactttcattcatacacactcactaagttttacacgattataatttcttcatagccagtactgtttaagcttcactgtctctgaatcggcaaaggtaaacgtatcaattattctacaaacccttttatttttcttttgaattaccgtcttcattggttatatgataacttgataagtaaagcttcaataattgaatttgatctgtgtttttttggccttaatactaaatccttacataagctttgttgcttctcctcttgtgagttgagtgttaagttgtaataatggttcactttcagctttagaagaaaccatggaagttgttgagaggttctacggagagttggatggaaaggtttcccaaggagtgaacgctttgttgggatctttcggagttgagttgactgataccccaactactaagggattgccactcgttgattctccaactccaattgtgttgggagtgtctgtttacttgaccatcgtgatcggaggattgctttggatcaaggctagagatctcaagccaagagcttctgagccattcttgttgcaagctttggtgttggtgcacaacttgttctgcttcgctttgtctctttacatgtgcgtgggtatcgcttaccaagctatcacctggagatattccttgtggggaaacgcttataacccaaagcacaaggagatggctatcctcgtttacctcttctacatgtccaagtacgtggagttcatggataccgtgatcatgatcctcaagagatccaccagacagatttctttcctccacgtgtaccaccactcttctatctcccttatctggtgggctattgctcaccacgctccaggaggagaggcttattggagtgctgctctcaactctggagtgcacgtgttgatgtacgcttactacttcttggctgcttgcttgagatcttccccaaagctcaagaacaagtacctcttctggggaagatacctcacccaattccagatgttccagttcatgctcaacttggtgcaagcttactacgatatgaaaaccaacgctccatatccacaatggctcatcaagatcctcttctactacatgatctccctcttgttcctcttcggaaacttctacgtgcaaaagtacatcaagccatccgatggaaagcaaaagggagctaagaccgagtgatcgacaagctcgagtttctccataataatgtgtgagtagttcccagataagggaattagggttcctatagggtttcgctcatgtgttgagcatataagaaacccttagtatgtatttgtatttgtaaaatacttctatcaataaaatttctaattcctaaaaccaaaatccagtactaaaatccagatcccccgaattaattcggcgttaattcagctagctagcctcagctgacgttacgtaacgctaggtagcgtcacgtgacgttagctaacgctaggtagcgtcagctgagcttacgtaagcgcttagcagatatttggtgtctaaatgtttattttgtgatatgttcatgtttgaaatggtggtttcgaaaccagggacaacgttgggatctgatagggtgtcaaagagtattatggattgggacaatttcggtcatgagttgcaaattcaagtatatcgttcgattatgaaaattttcgaagaatatcccatttgagagagtctttacctcattaatgtttttagattatgaaattttatcatagttcatcgtagtctttttggtgtaaaggctgtaaaaagaaattgttcacttttgttttcgtttatgtgaaggctgtaaaagattgtaaaagactattttggtgttttggataaaatgatagtttttatagattcttttgcttttagaagaaatacatttgaaattttttccatgttgagtataaaataccgaaatcgattgaagatcatagaaatattttaactgaaaacaaatttataactgattcaattctctccatttttatacctatttaaccgtaatcgattctaatagatgatcgattttttatataatcctaattaaccaacggcatgtattggataattaaccgatcaactctcacccctaatagaatcagtattttccttcgacgttaattgatcctacactatgtaggtcatatccatcgttttaatttttggccaccattcaattctgtcttgcctttagggatgtgaatatgaacggccaaggtaagagaataaaaataatccaaattaaagcaagagaggccaagtaagataatccaaatgtacacttgtcattgccaaaattagtaaaatactcggcatattgtattcccacacattattaaaataccgtatatgtattggctgcatttgcatgaataatactacgtgtaagcccaaaagaacccacgtgtagcccatgcaaagttaacactcacgaccccattcctcagtctccactatataaacccaccatccccaatctcaccaaacccaccacacaactcacaactcactctcacaccttaaagaaccaatcaccaccaaaaaatttcacgatttggaatttgattcctgcgatcacaggtatgacaggttagattttgttttgtatagttgtatacatacttctttgtgatgttttgtttacttaatcgaatttttggagtgttttaaggtctctcgtttagaaatcgtggaaaatatcactgtgtgtgtgttcttatgattcacagtgtttatgggtttcatgttctttgttttatcattgaatgggaagaaatttcgttgggatacaaatttctcatgttcttactgatcgttattaggagtttggggaaaaaggaagagtttttttggttggttcgagtgattatgaggttatttctgtatttgatttatgagttaatggtcgttttaatgttgtagaccatgggaaaaggatctgagggaagatctgctgctagagagatgactgctgaggctaacggagataagagaaagaccatcctcattgagggagtgttgtacgatgctaccaacttcaaacacccaggaggttccattattaacttcctcaccgagggagaagctggagttgatgctacccaagcttacagagagttccatcagagatccggaaaggctgataagtacctcaagtccctcccaaagttggatgcttctaaggtggagtctaggttctctgctaaggagcaggctagaagggacgctatgaccagggattacgctgctttcagagaggagttggttgctgagggatacttcgatccatctatcccacacatgatctacagagtggtggagattgtggctttgttcgctttgtctttctggttgatgtctaaggcttctccaacctctttggttttgggagtggtgatgaacggaatcgctcaaggaagatgcggatgggttatgcacgagatgggacacggatctttcactggagttatctggctcgatgataggatgtgcgagttcttctacggagttggatgtggaatgtctggacactactggaagaaccagcactctaagcaccacgctgctccaaacagattggagcacgatgtggatttgaacaccttgccactcgttgctttcaacgagagagttgtgaggaaggttaagccaggatctttgttggctttgtggctcagagttcaggcttatttgttcgctccagtgtcttgcttgttgatcggattgggatggaccttgtacttgcacccaagatatatgctcaggaccaagagacacatggagtttgtgtggatcttcgctagatatatcggatggttctccttgatgggagctttgggatattctcctggaacttctgtgggaatgtacctctgctctttcggacttggatgcatctacatcttcctccaattcgctgtgtctcacacccacttgccagttaccaacccagaggatcaattgcactggcttgagtacgctgctgatcacaccgtgaacatctctaccaagtcttggttggttacctggtggatgtctaacctcaacttccaaatcgagcaccacttgttcccaaccgctccacaattcaggttcaaggagatctctccaagagttgaggctctcttcaagagacacaacctcccttactacgatttgccatacacctctgctgtttctactaccttcgctaacctctactctgttggacactctgttggagctgataccaagaagcaggattgactgctttaatgagatatgcgagacgcctatgatcgcatgatatttgctttcaattctgttgtgcacgttgtaaaaaacctgagcatgtgtagctcagatccttaccgccggtttcggttcattctaatgaatatatcacccgttactatcgtatttttatgaataatattctccgttcaatttactgattgtctacgtaggctcagctgagcttacctaaggctacgtaggctcacgtgacgttacgtaaggctacgtagcgtcacgtgagcttacctaactctagctagcctcacgtgaccttagctaacactaggtagcgtcagctcgacggcccggactgtatccaacttctgatctttgaatctctctgttccaacatgttctgaaggagttctaagacttttcagaaagcttgtaacatgctttgtagactttctttgaattactcttgcaaactctgattgaacctacgtgaaaactgctccagaagttctaaccaaattccgtcttgggaaggcccaaaatttattgagtacttcagtttcatggacgtgtcttcaaagatttataacttgaaatcccatcatttttaagagaagttctgttccgcaatgtcttagatctcattgaaatctacaactcttgtgtcagaagttcttccagaatcaacttgcatcatggtgaaaatctggccagaagttctgaacttgtcatatttcttaacagttagaaaaatttctaagtgtttagaattttgacttttccaaagcaaacttgacttttgactttcttaataaaacaaacttcatattctaacatgtcttgatgaaatgtgattcttgaaatttgatgttgatgcaaaagtcaaagtttgacttttcagtgtgcaattgaccattttgctcttgtgccaattccaaacctaaattgatgtatcagtgctgcaaacttgatgtcatggaagatcttatgagaaaattcttgaagactgagaggaaaaattttgtagtacaacacaaagaatcctgtttttcatagtcggactagacacattaacataaaacaccacttcattcgaagagtgattgaagaaggaaatgtgcagttacctttctgcagttcataagagcaacttacagacacttttactaaaatactacaaagaggaagattttaacaacttagagaagtaatgggagttaaagagcaacacattaagggggagtgttaaaattaatgtgttgtaaccaccactacctttagtaagtattataagaaaattgtaatcatcacattataattattgtccttatttaaaattatgataaagttgtatcattaagattgagaaaaccaaatagtcctcgtcttgatttttgaattattgttttctatgttacttttcttcaagcctatataaaaactttgtaatgctaaattgtatgctggaaaaaaatgtgtaatgaattgaatagaaattatggtatttcaaagtccaaaatccatcaatagaaatttagtacaaaacgtaactcaaaaatattctcttattttaaattttacaacaatataaaaatattctcttattttaaattttacaataatataatttatcacctgtcacctttagaataccaccaacaatattaatacttagatattttattcttaataattttgagatctctcaatatatctgatatttattttatatttgtgtcatattttcttatgttttagagttaacccttatatcttggtcaaactagtaattcaatatatgagtttgtgaaggacacattgacatcttgaaacattggttttaaccttgttggaatgttaaaggtaataaaacattcagaattatgaccatctattaatatacttcctttgtcttttaaaaaagtgtgcatgaaaatgctctatggtaagctagagtgtcttgctggcctgtgtatatcaattccatttccagatggtagaaactgccactacgaataattagtcataagacacgtatgttaacacacgtccccttgcatgttttttgccatatattccgtctctttctttttcttcacgtataaaacaatgaactaattaatagagcgatcaagctgaacagttctttgctttcgaagttgccgcaacctaaacaggtttttccttcttctttcttcttattaactacgaccttgtcctttgcctatgtaaaattactaggttttcatcagttacactgattaagttcgttatagtggaagataaaatgccctcaaagcattttgcaggatatctttgatttttcaaagatatggaactgtagagtttgatagtgttcttgaatgtggttgcatgaagtttttttggtctgcatgttattttttcctcgaaatatgttttgagtccaacaagtgattcacttgggattcagaaagttgttttctcaatatgtaacagtttttttctatggagaaaaatcatagggaccgttggttttggcttctttaattttgagctcagattaaacccattttacccggtgttcttggcagaattgaaaacagtacgtagtaccgcgcctaccatgtgtgttgagaccgagaacaacgatggaatccctactgtggagatcgctttcgatggagagagagaaagagctgaggctaacgtgaagttgtctgctgagaagatggaacctgctgctttggctaagaccttcgctagaagatacgtggttatcgagggagttgagtacgatgtgaccgatttcaaacatcctggaggaaccgtgattttctacgctctctctaacactggagctgatgctactgaggctttcaaggagttccaccacagatctagaaaggctaggaaggctttggctgctttgccttctagacctgctaagaccgctaaagtggatgatgctgagatgctccaggatttcgctaagtggagaaaggagttggagagggacggattcttcaagccttctcctgctcatgttgcttacagattcgctgagttggctgctatgtacgctttgggaacctacttgatgtacgctagatacgttgtgtcctctgtgttggtttacgcttgcttcttcggagctagatgtggatgggttcaacacgagggaggacactcttctttgaccggaaacatctggtgggataagagaatccaagctttcactgctggattcggattggctggatctggagatatgtggaactccatgcacaacaagcaccacgctactcctcaaaaagtgaggcacgatatggatttggataccactcctgctgttgctttcttcaacaccgctgtggaggataatagacctaggggattctctaagtactggctcagattgcaagcttggaccttcattcctgtgacttctggattggtgttgctcttctggatgttcttcctccacccttctaaggctttgaagggaggaaagtacgaggagcttgtgtggatgttggctgctcacgtgattagaacctggaccattaaggctgttactggattcaccgctatgcaatcctacggactcttcttggctacttcttgggtttccggatgctacttgttcgctcacttctctacttctcacacccacttggatgttgttcctgctgatgagcacttgtcttgggttaggtacgctgtggatcacaccattgatatcgatccttctcagggatgggttaactggttgatgggatacttgaactgccaagtgattcaccacctcttcccttctatgcctcaattcagacaacctgaggtgtccagaagattcgttgctttcgctaagaagtggaacctcaactacaaggtgatgacttatgctggagcttggaaggctactttgggaaacctcgataatgtgggaaagcactactacgtgcacggacaacactctggaaagaccgcttgattaatgaaggccgcctcgaccgtaccccctgcagatagactatactatgttttagcctgcctgctggctagctactatgttatgttatgttgtaaaataaacacctgctaaggtatatctatctatattttagcatggctttctcaataaattgtctttccttatcgtttactatcttatacctaataatgaaataataatatcacatatgaggaacggggcaggtttaggcatatatatacgagtgtagggcggagtggggctacgtagcgtcacgtgacgttacctaagcctaggtagcctcagctgacgttacgtaacgctaggtaggctcagctgacacgggcaggacatagggactactacaagcatagtatgcttcagacaaagagctaggaaagaactcttgatggaggttaagagaaaaaagtgctagaggggcatagtaatcaaacttgtcaaaaccgtcatcatgatgagggatgacataatataaaaagttgactaaggtcttggtagtactctttgattagtattatatattggtgagaacatgagtcaagaggagacaagaaaccgaggaaccatagtttagcaacaagatggaagttgcaaagttgagctagccgctcgattagttacatctcctaagcagtactacaaggaatggtctctatactttcatgtttagcacatggtagtgcggattgacaagttagaaacagtgcttaggagacaaagagtcagtaaaggtattgaaagagtgaagttgatgctcgacaggtcaggagaagtccctccgccagatggtgactaccaaggggttggtatcagctgagacccaaataagattcttcggttgaaccagtggttcgaccgagactcttagggtgggatttcactgtaagatttgtgcattttgttgaatataaattgacaattttttttatttaattatagattatttagaatgaattacatatttagtttctaacaaggatagcaatggatgggtatgggtacaggttaaacatatctattacccacccatctagtcgtcgggttttacacgtacccacccgtttacataaaccagaccggaattttaaaccgtacccgtccgttagcgggtttcagatttacccgtttaatcgggtaaaacctgattactaaatatatattttttatttgataaacaaaacaaaaatgttaatattttcatattggatgcaattttaagaaacacatattcataaatttccatatttgtaggaaaataaaaagaaaaatatattcaagaacacaaatttcaccgacatgacttttattacagagttggaattagatctaacaattgaaaaattaaaattaagatagaatatgttgaggaacatgacatagtataatgctgggttacccgtcgggtaggtatcgaggcggatactactaaatccatcccactcgctatccgataatcactggtttcgggtatacccattcccgtcaacaggcctttttaaccggataatttcaacttatagtgaatgaattttgaataaatagttagaataccaaaatcctggattgcatttgcaatcaaattttgtgaaccgttaaattttgcatgtacttgggatagatataatagaaccgaattttcattagtttaatttataacttactttgttcaaagaaaaaaaatatctatccaatttacttataataaaaaataatctatccaagttacttattataatcaacttgtaaaaaggtaagaatacaaatgtggtagcgtacgtgtgattatatgtgacgaaatgttatatctaacaaaagtccaaattcccatggtaaaaaaaatcaaaatgcatggcaggctgtttgtaaccttggaataagatgttggccaattctggagccgccacgtacgcaagactcagggccacgttctcttcatgcaaggatagtagaacaccactccacccacctcctatattagacctttgcccaaccctccccaactttcccatcccatccacaaagaaaccgacatttttatcataaatctggtgcttaaacactctggtgagttctagtacttctgctatgatcgatctcattaccatttcttaaatttctctccctaaatattccgagttcttgatttttgataacttcaggttttctctttttgataaatctggtctttccatttttttttttttgtggttaatttagtttcctatgttcttcgattgtattatgcatgatctgtgtttggattctgttagattatgtattggtgaatatgtatgtgtttttgcatgtctggttttggtcttaaaaatgttcaaatctgatgatttgattgaagcttttttagtgttggtttgattcttctcaaaactactgttaatttactatcatgttttccaactttgattcatgatgacacttttgttctgctttgttataaaattttggttggtttgattttgtaattatagtgtaattttgttaggaatgaacatgttttaatactctgttttcgatttgtcacacattcgaattattaatcgataatttaactgaaaattcatggttctagatcttgttgtcatcagattatttgtttcgataattcatcaaatatgtagtccttttgctgatttgcgactgtttcattttttctcaaaattgttttttgttaagtttatctaacagttatcgttgtcaaaagtctctttcattttgcaaaatcttctttttttttttgtttgtaactttgttttttaagctacacatttagtctgtaaaatagcatcgaggaacagttgtcttagtagacttgcatgttcttgtaacttctatttgtttcagtttgttgatgactgctttgattttgtaggtcaaaggcgcaccctaccatggatgcttataacgctgctatggataagattggagctgctatcatcgattggagtgatccagatggaaagttcagagctgatagggaggattggtggttgtgcgatttcagatccgctatcaccattgctctcatctacatcgctttcgtgatcttgggatctgctgtgatgcaatctctcccagctatggacccataccctatcaagttcctctacaacgtgtctcaaatcttcctctgcgcttacatgactgttgaggctggattcctcgcttataggaacggatacaccgttatgccatgcaaccacttcaacgtgaacgatccaccagttgctaacttgctctggctcttctacatctccaaagtgtgggatttctgggataccatcttcattgtgctcggaaagaagtggagacaactctctttcttgcacgtgtaccaccacaccaccatcttcctcttctactggttgaacgctaacgtgctctacgatggagatatcttcttgaccatcctcctcaacggattcattcacaccgtgatgtacacctactacttcatctgcatgcacaccaaggattctaagaccggaaagtctttgccaatctggtggaagtcatctttgaccgctttccaactcttgcaattcaccatcatgatgtcccaagctacctacttggttttccacggatgcgataaggtttccctcagaatcaccatcgtgtacttcgtgtacattctctcccttttcttcctcttcgctcagttcttcgtgcaatcctacatggctccaaagaagaagaagtccgcttgatgttaatgaaggccgcagatatcagatctggtcgacctagaggatccccggccgcaaagataataacaaaagcctactatataacgtacatgcaagtattgtatgatattaatgtttttacgtacgtgtaaacaaaaataattacgtttgtaacgtatggtgatgatgtggtgcactaggtgtaggccttgtattaataaaaagaagtttgttctatatagagtggtttagtacgacgatttatttactagtcggattggaatagagaaccgaattcttcaatccttgcttttgatcaagaattgaaaccgaatcaaatgtaaaagttgatatatttgaaaaacgtattgagcttatgaaaatgctaatactctcatctgtatggaaaagtgactttaaaaccgaacttaaaagtgacaaaaggggaatatcgcatcaaaccgaatgaaaccgatctacgtaggctcagctgagcttagctaagcctacctagcctcacgtgagattatgtaaggctaggtagcgtcacgtgacgttacctaacactagctagcgtcagctgagcttagctaaccctacgtagcctcacgtgagcttacctaacgctacgtagcctcacgtgactaaggatgacctacccattcttgagacaaatgttacattttagtatcagagtaaaatgtgtacctataactcaaattcgattgacatgtatccattcaacataaaattaaaccagcctgcacctgcatccacatttcaagtattttcaaaccgttcggctcctatccaccgggtgtaacaagacggattccgaatttggaagattttgactcaaattcccaatttatattgaccgtgactaaatcaactttaacttctataattctgattaagctcccaatttatattcccaacggcactacctccaaaatttatagactctcatccccttttaaaccaacttagtaaacgttttttttttaattttatgaagttaagtttttaccttgtttttaaaaagaatcgttcataagatgccatgccagaacattagctacacgttacacatagcatgcagccgcggagaattgtttttcttcgccacttgtcactcccttcaaacacctaagagcttctctctcacagcacacacatacaatcacatgcgtgcatgcattattacacgtgatcgccatgcaaatctcctttatagcctataaattaactcatcggcttcactctttactcaaaccaaaactcatcaatacaaacaagattaaaaacatttcacgatttggaatttgattcctgcgatcacaggtatgacaggttagattttgttttgtatagttgtatacatacttctttgtgatgttttgtttacttaatcgaatttttggagtgttttaaggtctctcgtttagaaatcgtggaaaatatcactgtgtgtgtgttcttatgattcacagtgtttatgggtttcatgttctttgttttatcattgaatgggaagaaatttcgttgggatacaaatttctcatgttcttactgatcgttattaggagtttggggaaaaaggaagagtttttttggttggttcgagtgattatgaggttatttctgtatttgatttatgagttaatggtcgttttaatgttgtagaccgccatggctattttgaaccctgaggctgattctgctgctaacctcgctactgattctgaggctaagcaaagacaattggctgaggctggatacactcacgttgagggtgctcctgctcctttgcctttggagttgcctcacttctctctcagagatctcagagctgctattcctaagcactgcttcgagagatctttcgtgacctccacctactacatgatcaagaacgtgttgacttgcgctgctttgttctacgctgctaccttcattgatagagctggagctgctgcttatgttttgtggcctgtgtactggttcttccagggatcttacttgactggagtgtgggttatcgctcacgagtgtggacaccaggcttattgctcttctgaggtggtgaacaacttgattggactcgtgttgcactctgctttgttggtgccttaccactcttggagaatctctcacagaaagcaccactccaacactggatcttgcgagaacgatgaggttttcgttcctgtgaccagatctgtgttggcttcttcttggaacgagaccttggaggattctcctctctaccaactctaccgtatcgtgtacatgttggttgttggatggatgcctggatacctcttcttcaacgctactggacctactaagtactggggaaagtctaggtctcacttcaacccttactccgctatctatgctgatagggagaggtggatgatcgtgctctccgatattttcttggtggctatgttggctgttttggctgctttggtgcacactttctccttcaacacgatggtgaagttctacgtggtgccttacttcattgtgaacgcttacttggtgttgattacctacctccaacacaccgatacctacatccctcacttcagagagggagagtggaattggttgagaggagctttgtgcactgtggatagatcatttggtccattcctcgattctgtggtgcatagaatcgtggatacccacgtttgccaccatatcttctccaagatgcctttctatcactgcgaggaggctaccaacgctattaagcctctcctcggaaagttctacttgaaggatactactcctgttcctgttgctctctggagatcttacacccactgcaagttcgttgaggatgatggaaaggtggtgttctacaagaacaagttatagttaatgaataattgattggttcgagtattatggcattgggaaaactgtttttcttgtaccatttgttgtgcttgtaatttactgtgttttttattcggttttcgctatcgaactgtgaaatggaaatggatggagaagagttaatgaatgatatggtccttttgttcattctcaaattaatattatttgttttttctcttatttgttgtgtgttgaatttgaaattataagagatatgcaaacattttgttttgagtaaaaatgtgtcaaatcgtggcctctaatgaccgaagttaatatgaggagtaaaacacttgtagttgtaccattatgcttattcactaggcaacaaatatattttcagacctagaaaagctgcaaatgttactgaatacaagtatgtcctcttgtgttttagacatttatgaactttcctttatgtaattttccagaatccttgtcagattctaatcattgctttataattatagttatactcatggatttgtagttgagtatgaaaatattttttaatgcattttatgacttgccaattgattgacaacatgcatcaatgcggccgctagctagcctcagctgacgttacgtaacgctaggtagcgtcacgtgacgttagctaacgctaggtagcgtcagctgagcttacgtaagcgccacgggcaggacatagggactactacaagcatagtatgcttcagacaaagagctaggaaagaactcttgatggaggttaagagaaaaaagtgctagaggggcatagtaatcaaacttgtcaaaaccgtcatcatgatgagggatgacataatataaaaagttgactaaggtcttggtagtactctttgattagtattatatattggtgagaacatgagtcaagaggagacaagaaaccgaggaaccatagtttagcaacaagatggaagttgcaaagttgagctagccgctcgattagttacatctcctaagcagtactacaaggaatggtctctatactttcatgtttagcacatggtagtgcggattgacaagttagaaacagtgcttaggagacaaagagtcagtaaaggtattgaaagagtgaagttgatgctcgacaggtcaggagaagtccctccgccagatggtgactaccaaggggttggtatcagctgagacccaaataagattcttcggttgaaccagtggttcgaccgagactcttagggtgggatttcactgtaagatttgtgcattttgttgaatataaattgacaattttttttatttaattatagattatttagaatgaattacatatttagtttctaacaaggatagcaatggatgggtatgggtacaggttaaacatatctattacccacccatctagtcgtcgggttttacacgtacccacccgtttacataaaccagaccggaattttaaaccgtacccgtccgttagcgggtttcagatttacccgtttaatcgggtaaaacctgattactaaatatatattttttatttgataaacaaaacaaaaatgttaatattttcatattggatgcaattttaagaaacacatattcataaatttccatatttgtaggaaaataaaaagaaaaatatattcaagaacacaaatttcaccgacatgacttttattacagagttggaattagatctaacaattgaaaaattaaaattaagatagaatatgttgaggaacatgacatagtataatgctgggttacccgtcgggtaggtatcgaggcggatactactaaatccatcccactcgctatccgataatcactggtttcgggtatacccattcccgtcaacaggcctttttaaccggataatttcaacttatagtgaatgaattttgaataaatagttagaataccaaaatcctggattgcatttgcaatcaaattttgtgaaccgttaaattttgcatgtacttgggatagatataatagaaccgaattttcattagtttaatttataacttactttgttcaaagaaaaaaaatatctatccaatttacttataataaaaaataatctatccaagttacttattataatcaacttgtaaaaaggtaagaatacaaatgtggtagcgtacgtgtgattatatgtgacgaaatgttatatctaacaaaagtccaaattcccatggtaaaaaaaatcaaaatgcatggcaggctgtttgtaaccttggaataagatgttggccaattctggagccgccacgtacgcaagactcagggccacgttctcttcatgcaaggatagtagaacaccactccacccacctcctatattagacctttgcccaaccctccccaactttcccatcccatccacaaagaaaccgacatttttatcataaatcagggtttcgtttttgtttcatcgataaactcaaaggtgatgattttagggtcttgtgagtgtgcttttttgtttgattctactgtagggtttatgttctttagctcataggttttgtgtatttcttagaaatgtggcttctttaatctctgggtttgtgactttttgtgtggtttctgtgtttttcatatcaaaaacctattttttccgagtttttttttacaaattcttactctcaagcttgaatacttcacatgcagtgttcttttgtagattttagagttaatgtgttaaaaagtttggatttttcttgcttatagagcttcttcactttgattttgtgggtttttttgttttaaaggtgagatttttgatgaggtttttgcttcaaagatgtcacctttctgggtttgtcttttgaataaagctatgaactgtcacatggctgacgcaattttgttactatgtcatgaaagctgacgtttttccgtgttatacatgtttgcttacacttgcatgcgtcaaaaaaattggggctttttagttttagtcaaagattttacttctcttttgggatttatgaaggaaagttgcaaactttctcaaattttaccatttttgctttgatgtttgtttagattgcgacagaacaaactcatatatgttgaaatttttgcttggttttgtataggattgtgtcttttgcttataaatgttgaaatctgaactttttttttgtttggtttctttgagcaggagataaggcgcaccaccatggcttctacatctgctgctcaagacgctgctccttacgagttcccttctctcactgagatcaagagggctcttccttctgagtgtttcgaggcttctgttcctctttctctctactacaccgctagatctcttgctcttgctggatctctcgctgttgctctctcttacgctagagctttgcctcttgttcaggctaacgctcttcttgatgctactctctgcactggatacgttcttctccagggaatcgttttctggggattcttcaccgttggtcacgattgtggacacggagctttctctagatctcacgtgctcaacttctctgttggaaccctcatgcactctatcatccttacccctttcgagtcttggaagctctctcacagacaccaccacaagaacaccggaaacatcgataaggacgagatcttctaccctcaaagagaggctgattctcaccctgtttctagacaccttgtgatgtctcttggatctgcttggttcgcttaccttttcgctggattccctcctagaaccatgaaccacttcaacccttgggaggctatgtatgttagaagagtggctgctgtgatcatctctctcggagttcttttcgctttcgctggactctactcttacctcaccttcgttcttggattcaccactatggctatctactacttcggacctctcttcatcttcgctaccatgcttgttgttaccactttcctccaccacaacgatgaggagacaccttggtacgctgattctgagtggacttacgtgaagggaaacctctcttctgtggacagatcttacggtgctctcatcgacaaccttagccacaacatcggaactcaccagatccaccacctcttccctatcatccctcactacaagctcaacgatgctactgctgctttcgctaaggctttccctgagcttgttaggaaaaacgctgctcctatcatcccaactttcttcaggatggctgctatgtacgctaagtacggagttgttgacactgatgctaagaccttcactctcaaggaggctaaggctgctgctaagactaagtcatcttgatgattaatgaaggccgcagatatcagatctggtcgacctagaggatccccggccgcaaagataataacaaaagcctactatataacgtacatgcaagtattgtatgatattaatgtttttacgtacgtgtaaacaaaaataattacgtttgtaacgtatggtgatgatgtggtgcactaggtgtaggccttgtattaataaaaagaagtttgttctatatagagtggtttagtacgacgatttatttactagtcggattggaatagagaaccgaattcttcaatccttgcttttgatcaagaattgaaaccgaatcaaatgtaaaagttgatatatttgaaaaacgtattgagcttatgaaaatgctaatactctcatctgtatggaaaagtgactttaaaaccgaacttaaaagtgacaaaaggggaatatcgcatcaaaccgaatgaaaccgatctacgtaggctcagctgagcttacctaaggctacgtaggctcacgtgacgttacgtaaggctacgtagcgtcacgtgagcttacctaactctagctagcctcacgtgaccttagctaacactaggtagcgtcagcacagatgaatactagctgttgttcacagttctagtgtctcctcattacgtgaattcaagctacgatcactatctcaactcctacataaacatcagaatgctacaaaactatgcacaaaaacaaaagctacatctaatacgtgaatcaattactctcatcacaagaaagaagatttcaatcaccgtcgagaaggaggattcagttaattgaatcaaagttccgatcaaactcgaagactggtgagcacgaggacgacgaagaagagtgtctcgaagatacaacaagcaagaaatctactgagtgacctcctgaagttattggcgcgattgagagaatcaatccgaattaatttcggggaaaaagataaattagatactaagcgatgggcttgggctgggctaagaaacaggtggcaattgggctggaggaccccgcgattcatagcttccgatagcccaaaaaaaaacggataacatatttatcgggtatttgaatttcagtgaaataagatattttctttttgttaggaaaattttagaaaataatggaaattaaatagcgattatgttacaagatacgatcagcatcgggcagtgcaaaatgctatagcttcccaagatttgatccttttgggttatctcctaatgacaattagtttaggattttgaaacttatattaatactattatccgacaacacttgtttcagcttcttattttaacattttttgtttttttctattcttcttcccatcagcattttctttttaaaaaattgaatactttaactttttaaaaatttcacaatgatcagatgatattatggaagatctcaagagttaaatgtatccatcttggggcattaaaaccggtgtacgggatgataaatacagactttatatcatatgatagctcagtaattcatatttatcacgttgctaaaaaaattataaggtactagtagtcaacaaaatcaattaaagagaaagaaagaaacgcatgtgaagagagtttacaactggaaaagtaaaataaaaattaacgcatgttgaatgctgacatgtcagtatgtccatgaatccacgtatcaagcgccattcatcgatcgtcttcctctttctaaatgaaaacaacttcacacatcacaacaaacaatacacacaagaccccctctctctcgttgtctctctgccagcgaccaaatcgaagcttgagaagaacaagaaggggtcaaaccatgggaaaaggatctgagggaagatctgctgctagagagatgactgctgaggctaacggagataagagaaagaccatcctcattgagggagtgttgtacgatgctaccaacttcaaacacccaggaggttccattattaacttcctcaccgagggagaagctggagttgatgctacccaagcttacagagagttccatcagagatccggaaaggctgataagtacctcaagtccctcccaaagttggatgcttctaaggtggagtctaggttctctgctaaggagcaggctagaagggacgctatgaccagggattacgctgctttcagagaggagttggttgctgagggatacttcgatccatctatcccacacatgatctacagagtggtggagattgtggctttgttcgctttgtctttctggttgatgtctaaggcttctccaacctctttggttttgggagtggtgatgaacggaatcgctcaaggaagatgcggatgggttatgcacgagatgggacacggatctttcactggagttatctggctcgatgataggatgtgcgagttcttctacggagttggatgtggaatgtctggacactactggaagaaccagcactctaagcaccacgctgctccaaacagattggagcacgatgtggatttgaacaccttgccactcgttgctttcaacgagagagttgtgaggaaggttaagccaggatctttgttggctttgtggctcagagttcaggcttatttgttcgctccagtgtcttgcttgttgatcggattgggatggaccttgtacttgcacccaagatatatgctcaggaccaagagacacatggagtttgtgtggatcttcgctagatatatcggatggttctccttgatgggagctttgggatattctcctggaacttctgtgggaatgtacctctgctctttcggacttggatgcatctacatcttcctccaattcgctgtgtctcacacccacttgccagttaccaacccagaggatcaattgcactggcttgagtacgctgctgatcacaccgtgaacatctctaccaagtcttggttggttacctggtggatgtctaacctcaacttccaaatcgagcaccacttgttcccaaccgctccacaattcaggttcaaggagatctctccaagagttgaggctctcttcaagagacacaacctcccttactacgatttgccatacacctctgctgtttctactaccttcgctaacctctactctgttggacactctgttggagctgataccaagaagcaggattgatgattaatgaataattgattgtacatactatattttttgtttaccttgtgttagtttaatgttcagtgtcctctctttattgtggcacgtctctttgttgtatgttgtgtctatacaaagttgaaataatggaaagaaaaggaagagtgtaatttgttttgttttaagtgtttataaatatatatatataggtcatttagatagttctaggtttctataaaactctctctctggaagtagaatctgtttttgagaggatccagttgcctactaatctcccccaaaacccttcaagcttaaccttcctcttcacaacaacagaggaaacacatctcttgagctctgagttctcttctttgagcatgtctatcgctaaactcatctgccttatagcttccctcttctcttcatctctctctctcaccatttcgctgtaaaacttattctcctccctcagcctctctatctcttccttcagcatctcacaattcccaccataatcgactgaggatgattcaccgtcatcaacttcagactcagcgttgtagtcgtcatgagtctcacaagccttggaccaagaagactcatcatcgcaagttgatgatttatcatgatgcttctctgagccgtgtttgctacgtagcgtcacctgacgttacgtaaggctacctaggctcacgtgacgttacgtaacgctacgtagcgtcaggtgaggttagctaacgctagctagcctcacctgacgttaggtaaggctacgtagcgtcacctgagattagctaagcctacctagactcacgtgaccttaggtaacgctacgtagcgtcaaagctttacaacgctacacaaaacttataaccgtaatcaccattcattaacttaactactatcacatgcattcatgaattgaaacgagaaggatgtaaatagttgggaagttatctccacgttgaagagatcgttagcgagagctgaaagaccgagggaggagacgccgtcaacacggacagagtcgtcgaccctcacatgaagtaggaggaatctccgtgaggagccagagagacgtctttggtcttcggtttcgatccttgatctgacggagaagacgagagaagtgcgactggactccgtgaggaccaacagagtcgtcctcggtttcgatcgtcggtattggtggagaaggcggaggaatctccgtgacgagccagagagatgtcgtcggtcttcggtttcgatccttgatctgacggagaagacgagagaagtgcgacgagactccgtgaggaccaacagagttgtcctcggtttcgatcgtcggtttcggcggagaaggcggaggaatctccgtgaggagccagagagacgtcgttggtcttcggtttcgatccttgatctgttggagaagacgagacaagtgggacgagactcaacgacggagtcagagacgtcgtcggtcttcggtttcggccgagaaggcggagtcggtcttcggtttcggccgagaaggcggaggagacgtcttcgatttgggtctctcctcttgacgaagaaaacaaagaacacgagaaataatgagaaagagaacaaaagaaaaaaaaataaaaataaaaataaaatttggtcctcttatgtggtgacacgtggtttgaaacccaccaaataatcgatcacaaaaaacctaagttaaggatcggtaataacctttctaattaattttgatttatattaaatcactctttttatttataaaccccactaaattatgcgatattgattgtctaagtacaaaaattctctcgaattcaatacacatgtttcatatatttagccctgttcatttaatattactagcgcatttttaatttaaaattttgtaaacttttttggtcaaagaacatttttttaattagagacagaaatctagactctttatttggaataatagtaataaagatatattaggcaatgagtttatgatgttatgtttatatagtttatttcattttaaattgaaaagcattatttttatcgaaatgaatctagtatacaatcaatatttatgttttttcatcagatactttcctattttttggcacctttcatcggactactgatttatttcaatgtgtatgcatgcatgagcatgagtatacacatgtcttttaaaatgcatgtaaagcgtaacggaccacaaaagaggatccatacaaatacatctcatcgcttcctctactattctccgacacacacactgagcatggtgcttaaacactctggtgagttctagtacttctgctatgatcgatctcattaccatttcttaaatttctctccctaaatattccgagttcttgatttttgataacttcaggttttctctttttgataaatctggtctttccattttttttttgtggttaatttagtttcctatgttcttcgattgtattatgcatgatctgtgtttggattctgttagattatgtattggtgaatatgtatgtgtttttgcatgtctggttttggtcttaaaaatgttcaaatctgatgatttgattgaagcttttttagtgttggtttgattcttctcaaaactactgttaatttactatcatgttttccaactttgattcatgatgacacttttgttctgctttgttataaaattttggttggtttgattttgtaattatagtgtaattttgttaggaatgaacatgttttaatactctgttttcgatttgtcacacattcgaattattaatcgataatttaactgaaaattcatggttctagatcttgttgtcatcagattatttgtttcgataattcatcaaatatgtagtccttttgctgatttgcgactgtttcattttttctcaaaattgttttttgttaagtttatctaacagttatcgttgtcaaaagtctctttcattttgcaaaatcttctttttttttttgtttgtaactttgttttttaagctacacatttagtctgtaaaatagcatcgaggaacagttgtcttagtagacttgcatgttcttgtaacttctatttgtttcagtttgttgatgactgctttgattttgtaggtcaaaccgcgccatgtctgctagcggagctttgttgcctgctatagctttcgctgcttacgcttacgctacctacgcttatgctttcgagtggagccacgctaacggaatcgataacgtggatgctagagagtggattggagctttgtctttgagactccctgcaattgcaaccacaatgtacctcttgttctgccttgtgggacctagattgatggctaagagggaggcttttgatcctaagggatttatgctcgcttacaacgcttaccaaaccgctttcaacgttgtggtgctcggaatgttcgctagagagatctctggattgggacaacctgtttggggatctactatgccttggagcgataggaagtccttcaagattttgttgggagtgtggctccactacaacaataagtacctcgagttgttggatactgtgttcatggtggctaggaaaaagaccaagcagctctctttcttgcacgtgtaccaccacgctttgttgatttgggcttggtggcttgtttgtcacctcatggctaccaacgattgcatcgatgcttatttcggagctgcttgcaactctttcatccacatcgtgatgtactcctactacctcatgtctgctttgggaattaggtgcccttggaagagatatatcacccaggctcagatgttgcaattcgtgatcgtgttcgctcacgctgttttcgtgctcagacaaaagcactgccctgttactttgccttgggcacaaatgttcgtgatgacaaatatgttggtgctcttcggaaacttctacctcaaggcttactctaacaagtctaggggagatggagcttcttctgttaagcctgctgagactactagagcaccttctgtgagaagaaccaggtcaaggaagatcgattgatagttaatgaactaagtttgatgtatctgagtgccaacgtttactttgtctttcctttcttttattggttatgattagatgtttactatgttctctctttttcgttataaataaagaagttcaattcttctatagtttcaaacgcgattttaagcgtttctatttaggtttacatgatttcttttacaaaatcatctttaaaatacagtatatttttagttttcataaaatatttaaagaaatgaaagtttataaacattcactcctattctctaattaaggatttgtaaaacaaaaattttgtaagcatatcgatttatgcgttttgtcttaattagctcactaaataataaataatagcttatgttgtgggactgtttaattacctaacttagaactaaaatcaactctttgtgacgcgtctacctagagtcagctgagcttagctaacgctagctagtgtcagctgacgttacgtaaggctaactagcgtcacgtgaccttacgtaacgctacgtaggctcagctgagcttagctaaccctagctagtgtcacgtgagcttacgctactatagaaaatgtgttatatcgacatgaccagacaaaggggcaacagttaacaaaacaattaattctttcatttgagattaaggaaggtaaggtactaaaaagattaaaaaaaatgagcttatctctttgtttctgtaataataatataagtgtgataaacttttaatataataattgtaattaggttttctacagatgagcaccactcagagacaagataagaagaaaacaattttgttaaacatgattatagaaacttttagttaagtcttgaagtatcaatataacaaaaaaaagtacacacgactatgacaataaacccactaccgtcaggttatcatttcgatgaaatgttttgatatcattaaatataacagtcacaaaaaatcatctaattataacaatataacttatacatatatttaactaaaaacttagagtttttgtaatgattctaattgatgattagagtttatagaaatacaattaaataaaaaatataattttaaaaaaacatagtaaagtcaatgagatcctctctgacctcagtgatcatttagtcatgtatgtacaacaatcattgttcatcacatgactgtaaaataaataaggataaacttgggaatatatataatatattgtattaaataaaaaagggaaatacaaatatcaattttagattcccgagttgacacaactcaccatgcacgctgccacctcagctcccagctctcgtcacatgtctcatgtcagttaggtctttggtttttagtctttgacacaactcgccatgcatgttgccacgtgagctcgttcctcttcccatgatctcaccactgggcatgcatgctgccacctcagctggcacctcttctctatatgtccctagaggccatgcacagtgccacctcagcactcctctcagaacccatacgtacctgccaatcggcttctctccataaatatctatttaaattataactaattatttcatatacttaattgatgacgtggatgcattgccatcgttgtttaataattgttaattacgacatgataaataaaatgaaagtaaaaagtacgaaagattttccatttgttgttgtataaatagagaagtgagtgatgcataatgcatgaatgcatgaccgcgccaccatgactgttggatacgacgaggagatcccattcgagcaagttagggctcataacaagccagacgacgcttggtgtgctattcacggacacgtgtacgacgttaccaagttcgcttcagttcacccaggaggagatattatcttgctcgctgctggaaaggaagctactgtcctctacgagacctaccatgttagaggagtgtctgacgctgtgctcagaaagtacagaataggaaagttgccagacggacaaggaggagctaacgagaaggagaagagaaccttgtctggattgtcctctgcttcttactacacctggaactccgatttctacagagtgatgagggagagagttgtggctagattgaaggagagaggaaaggctagaagaggaggatacgaactctggatcaaggctttcttgctccttgttggattctggtcctctctttactggatgtgcaccctcgatccatctttcggagctatcttggctgctatgtctttgggagtgttcgctgcttttgttggaacctgcatccaacacgatggaaaccacggagctttcgctcaatctagatgggttaacaaggtggcaggatggactttggatatgatcggagcttctggaatgacttgggagttccaacacgtgttgggacaccacccatacactaacttgatcgaggaggagaacggattgcaaaaggtgtccggaaagaagatggataccaagttggctgatcaagagtctgatccagatgtgttctccacctacccaatgatgagattgcacccttggcaccagaagaggtggtatcacaggttccagcacatctacggacctttcatcttcggattcatgaccatcaacaaggtggtgactcaagatgttggagtggtgttgagaaagagactcttccaaatcgatgctgagtgcagatatgcttccccaatgtacgttgctaggttctggattatgaaggctttgaccgtgttgtatatggttgctttgccttgttatatgcaaggaccttggcacggattgaaactcttcgctatcgctcacttcacttgcggagaggttttggctaccatgttcatcgtgaaccacattatcgagggagtgtcttacgcttctaaggatgctgttaagggaactatggctccaccaaagactatgcacggagtgaccccaatgaacaacactagaaaggaggttgaggctgaggcttctaagtctggagctgtggttaagtctgtgccattggatgattgggctgctgttcagtgccaaacctctgtgaactggtctgttggatcttggttttggaaccacttctctggaggactcaaccaccaaatcgagcaccacctcttcccaggattgtctcacgagacctactaccacatccaagacgtggttcaatctacctgtgctgagtacggagttccataccaacacgagccatctttgtggactgcttactggaagatgctcgaacaccttagacaattgggaaacgaggagactcacgagtcatggcagagagctgcttgattaatgaactaagactcccaaaaccaccttccctgtgacagttaaaccctgcttatacctttcctcctaataatgttcatctgtcacacaaactaaaataaataaaatgggagcaataaataaaatgggagctcatatatttacaccatttacactgtctattattcaccatgccaattattacttcataattttaaaattatgtcatttttaaaaattgcttaatgatggaaaggattattataagttaaaagtataacatagataaactaaccacaaaacaaatcaatataaactaacttactctcccatctaatttttatttaaatttctttacacttctcttccatttctatttctacaacattatttaacatttttattgtatttttcttactttctaactctattcatttcaaaaatcaatatatgtttatcaccacctctctaaaaaaaactttacaatcattggtccagaaaagttaaatcacgagatggtcattttagcattaaaacaacgattcttgtatcactatttttcagcatgtagtccattctcttcaaacaaagacagcggctatataatcgttgtgttatattcagtctaaaacaactacgtagcgtcacgtgacgttacctaagcctaggtagcctcagctgacgttacgtaacgctaggtaggctcagctgactgcagcaaatttacacattgccactaaacgtctaaacccttgtaatttgtttttgttttactatgtgtgttatgtatttgatttgcgataaatttttatatttggtactaaatttataacaccttttatgctaacgtttgccaacacttagcaatttgcaagttgattaattgattctaaattatttttgtcttctaaatacatatactaatcaactggaaatgtaaatatttgctaatatttctactataggagaattaaagtgagtgaatatggtaccacaaggtttggagatttaattgttgcaatgctgcatggatggcatatacaccaaacattcaataattcttgaggataataatggtaccacacaagatttgaggtgcatgaacgtcacgtggacaaaaggtttagtaatttttcaagacaacaatgttaccacacacaagttttgaggtgcatgcatggatgccctgtggaaagtttaaaaatattttggaaatgatttgcatggaagccatgtgtaaaaccatgacatccacttggaggatgcaataatgaagaaaactacaaatttacatgcaactagttatgcatgtagtctatataatgaggattttgcaatactttcattcatacacactcactaagttttacacgattataatttcttcatagccagtactgtttaagcttcactgtctctgaatcggcaaaggtaaacgtatcaattattctacaaacccttttatttttcttttgaattaccgtcttcattggttatatgataacttgataagtaaagcttcaataattgaatttgatctgtgtttttttggccttaatactaaatccttacataagctttgttgcttctcctcttgtgagttgagtgttaagttgtaataatggttcactttcagctttagaagaaacgcgccttccatggctacaaaggaggcttacgttttcccaactctcaccgagatcaagagatctctcccaaaggattgcttcgaggcttctgtgcctttgtctctctactacactgtgagatgcttggttattgctgtggctttgaccttcggattgaactacgctagagctttgccagaggttgagtctttctgggctttggatgctgctttgtgcactggatatatcctcctccagggaattgtgttctggggattcttcactgttggacacgatgctggacacggagctttctctagataccacctcttgaacttcgttgtgggaaccttcatgcactctctcatcttgaccccattcgagtcttggaagttgacccacagacaccaccacaagaacaccggaaacatcgatagagatgaggtgttctacccacagagaaaggctgatgatcacccattgtccaggaacttgatcttggctttgggagctgcttggcttgcttatttggtggagggattcccaccaagaaaggtgaaccacttcaacccattcgagccactttttgtgagacaagtgtccgctgtggttatctctttgctcgctcacttcttcgttgctggactctctatctacttgtctctccagttgggacttaagaccatggctatctactactacggaccagttttcgtgttcggatctatgttggtgattaccaccttcttgcaccacaacgatgaggagactccatggtatgctgattctgagtggacttacgtgaagggaaacttgtcctctgtggatagatcttacggtgctctcatcgataacctctcccacaacatcggaactcaccagatccaccacctcttcccaattatcccacactacaagctcaagaaggctactgctgctttccaccaagctttcccagagcttgtgagaaagtccgatgagccaatcatcaaggctttcttcagagtgggaaggttgtatgctaactacggagtggttgatcaagaggctaagctcttcactttgaaggaggctaaggctgctactgaagctgctgctaagaccaagtctacctgattaatgaatcgacaagctcgagtttctccataataatgtgtgagtagttcccagataagggaattagggttcctatagggtttcgctcatgtgttgagcatataagaaacccttagtatgtatttgtatttgtaaaatacttctatcaataaaatttctaattcctaaaaccaaaatccagtactaaaatccagatcccccgaattaattcggcgttaattcagctacgtagcgtcacctgacgttacgtaaggctacctaggctcacgtgacgttacgtaacgctacgtagcgtcaggtgaggttagctaacgctagctagcctcacctgacgttaggtaaggctacgtagcgtcacctgagattagctaagcctacctagactcacgtgaccttaggtaacgctacgtagcgtcaaagctttacaacgctacacaaaacttataaccgtaatcaccattcattaacttaactactatcacatgcattcatgaattgaaacgagaaggatgtaaatagttgggaagttatctccacgttgaagagatcgttagcgagagctgaaagaccgagggaggagacgccgtcaacacggacagagtcgtcgaccctcacatgaagtaggaggaatctccgtgaggagccagagagacgtctttggtcttcggtttcgatccttgatctgacggagaagacgagagaagtgcgactggactccgtgaggaccaacagagtcgtcctcggtttcgatcgtcggtattggtggagaaggcggaggaatctccgtgacgagccagagagatgtcgtcggtcttcggtttcgatccttgatctgacggagaagacgagagaagtgcgacgagactccgtgaggaccaacagagttgtcctcggtttcgatcgtcggtttcggcggagaaggcggaggaatctccgtgaggagccagagagacgtcgttggtcttcggtttcgatccttgatctgttggagaagacgagacaagtgggacgagactcaacgacggagtcagagacgtcgtcggtcttcggtttcggccgagaaggcggagtcggtcttcggtttcggccgagaaggcggaggagacgtcttcgatttgggtctctcctcttgacgaagaaaacaaagaacacgagaaataatgagaaagagaacaaaagaaaaaaaaataaaaataaaaataaaatttggtcctcttatgtggtgacacgtggtttgaaacccaccaaataatcgatcacaaaaaacctaagttaaggatcggtaataacctttctaattaattttgatttatattaaatcactctttttatttataaaccccactaaattatgcgatattgattgtctaagtacaaaaattctctcgaattcaatacacatgtttcatatatttagccctgttcatttaatattactagcgcatttttaatttaaaattttgtaaacttttttggtcaaagaacatttttttaattagagacagaaatctagactctttatttggaataatagtaataaagatatattaggcaatgagtttatgatgttatgtttatatagtttatttcattttaaattgaaaagcattatttttatcgaaatgaatctagtatacaatcaatatttatgttttttcatcagatactttcctattttttggcacctttcatcggactactgatttatttcaatgtgtatgcatgcatgagcatgagtatacacatgtcttttaaaatgcatgtaaagcgtaacggaccacaaaagaggatccatacaaatacatctcatcgcttcctctactattctccgacacacacactgagcatggtgcttaaacactctggtgagttctagtacttctgctatgatcgatctcattaccatttcttaaatttctctccctaaatattccgagttcttgatttttgataacttcaggttttctctttttgataaatctggtctttccatttttttttttttgtggttaatttagtttcctatgttcttcgattgtattatgcatgatctgtgtttggattctgttagattatgtattggtgaatatgtatgtgtttttgcatgtctggttttggtcttaaaaatgttcaaatctgatgatttgattgaagcttttttagtgttggtttgattcttctcaaaactactgttaatttactatcatgttttccaactttgattcatgatgacacttttgttctgctttgttataaaattttggttggtttgattttgtaattatagtgtaattttgttaggaatgaacatgttttaatactctgttttcgatttgtcacacattcgaattattaatcgataatttaactgaaaattcatggttctagatcttgttgtcatcagattatttgtttcgataattcatcaaatatgtagtccttttgctgatttgcgactgtttcattttttctcaaaattgttttttgttaagtttatctaacagttatcgttgtcaaaagtctctttcattttgcaaaatcttctttttttttttgtttgtaactttgttttttaagctacacatttagtctgtaaaatagcatcgaggaacagttgtcttagtagacttgcatgttcttgtaacttctatttgtttcagtttgttgatgactgctttgattttgtaggtcaaaccgcgccatgccacctagtgctgctagtgaaggtggtgttgctgaacttagagctgctgaagttgctagctacactagaaaggctgttgacgaaagacctgacctcactatagttggtgacgctgtttacgacgctaaggcttttagggacgagcaccctggtggtgctcacttcgttagccttttcggaggtagggacgctactgaggcttttatggaatatcaccgtagagcttggcctaaggctaggatgtctaagttcttcgttggttcacttgacgctagcgagaagcctactcaagctgattcagcttaccttagactttgcgctgaggttaacgctcttttgcctaagggtagcggaggattcgctcctcctagctactggcttaaggctgctgctcttgttgttgctgctgttagtatagagggttatatgctccttaggggtaagacccttttgcttagcgttttccttggactcgtgttcgcttggataggacttaatattcagcacgacgctaatcacggtgctcttagtagacactcagtgattaactactgcctcggttacgctcaggattggataggtggtaatatggtgctttggcttcaagagcacgttgtgatgcaccacctccacactaacgacgttgacgctgatcctgatcaaaaggctcacggtgttcttagacttaagcctactgacggttggatgccttggcacgcacttcaacaactctatatccttcctggtgaggctatgtacgcttttaagcttcttttcttggacgcccttgagcttcttgcttggaggtgggagggtgagaagattagccctcttgctagagctttgttcgctcctgctgttgcttgtaagcttggattctgggctagattcgttgctctccctctctggcttcaacctactgttcacactgctttgtgtatctgtgctactgtgtgtactggtagcttctacctcgccttcttcttctttatctctcacaacttcgacggtgttggtagcgttggacctaagggatcacttcctagatcagctactttcgttcaacgtcaggttgagactagctctaacgttggtggttactggcttggagttcttaacggtggacttaactttcagatagagcaccacttgttccctaggcttcaccactcttactacgctcaaatagctcctgtggttaggactcacatagagaagctcggttttaagtaccgtcacttccctaccgttggatctaaccttagctcaatgcttcagcatatgggtaagatgggaactagacctggtgctgagaagggtggtaaggctgagtagtagttaatgaactaagtttgatgtatctgagtgccaacgtttactttgtctttcctttcttttattggttatgattagatgtttactatgttctctctttttcgttataaataaagaagttcaattcttctatagtttcaaacgcgattttaagcgtttctatttaggtttacatgatttcttttacaaaatcatctttaaaatacagtatatttttagttttcataaaatatttaaagaaatgaaagtttataaacattcactcctattctctaattaaggatttgtaaaacaaaaattttgtaagcatatcgatttatgcgttttgtcttaattagctcactaaataataaataatagcttatgttgtgggactgtttaattacctaacttagaactaaaatcaactctttgtgctagctagcctcagctgacgttacgtaacgctaggtagcgtcacgtgacgttagctaacgctaggtagcgtcagctgagcttacgtaagcgcacagatgaatactagctgttgttcacagttctagtgtctcctcattacgtgaattcaagctacgatcactatctcaactcctacataaacatcagaatgctacaaaactatgcacaaaaacaaaagctacatctaatacgtgaatcaattactctcatcacaagaaagaagatttcaatcaccgtcgagaaggaggattcagttaattgaatcaaagttccgatcaaactcgaagactggtgagcacgaggacgacgaagaagagtgtctcgaagatacaacaagcaagaaatctactgagtgacctcctgaagttattggcgcgattgagagaatcaatccgaattaatttcggggaaaaagataaattagatactaagcgatgggcttgggctgggctaagaaacaggtggcaattgggctggaggaccccgcgattcatagcttccgatagcccaaaaaaaaacggataacatatttatcgggtatttgaatttcagtgaaataagatattttctttttgttaggaaaattttagaaaataatggaaattaaatagcgattatgttacaagatacgatcagcatcgggcagtgcaaaatgctatagcttcccaagatttgatccttttgggttatctcctaatgacaattagtttaggattttgaaacttatattaatactattatccgacaacacttgtttcagcttcttattttaacattttttgtttttttctattcttcttcccatcagcattttctttttaaaaaattgaatactttaactttttaaaaatttcacaatgatcagatgatattatggaagatctcaagagttaaatgtatccatcttggggcattaaaaccggtgtacgggatgataaatacagactttatatcatatgatagctcagtaattcatatttatcacgttgctaaaaaaattataaggtactagtagtcaacaaaatcaattaaagagaaagaaagaaacgcatgtgaagagagtttacaactggaaaagtaaaataaaaattaacgcatgttgaatgctgacatgtcagtatgtccatgaatccacgtatcaagcgccattcatcgatcgtcttcctctttctaaatgaaaacaacttcacacatcacaacaaacaatacacacaagaccccctctctctcgttgtctctctgccagcgaccaaatcgaagcttgagaagaacaagaaggggtcaaaccatggcttctacatctgctgctcaagacgctgctccttacgagttcccttctctcactgagatcaagagggctcttccttctgagtgtttcgaggcttctgttcctctttctctctactacaccgctagatctcttgctcttgctggatctctcgctgttgctctctcttacgctagagctttgcctcttgttcaggctaacgctcttcttgatgctactctctgcactggatacgttcttctccagggaatcgttttctggggattcttcaccgttggtcacgattgtggacacggagctttctctagatctcacgtgctcaacttctctgttggaaccctcatgcactctatcatccttacccctttcgagtcttggaagctctctcacagacaccaccacaagaacaccggaaacatcgataaggacgagatcttctaccctcaaagagaggctgattctcaccctgtttctagacaccttgtgatgtctcttggatctgcttggttcgcttaccttttcgctggattccctcctagaaccatgaaccacttcaacccttgggaggctatgtatgttagaagagtggctgctgtgatcatctctctcggagttcttttcgctttcgctggactctactcttacctcaccttcgttcttggattcaccactatggctatctactacttcggacctctcttcatcttcgctaccatgcttgttgttaccactttcctccaccacaacgatgaggagacaccttggtacgctgattctgagtggacttacgtgaagggaaacctctcttctgtggacagatcttacggtgctctcatcgacaaccttagccacaacatcggaactcaccagatccaccacctcttccctatcatccctcactacaagctcaacgatgctactgctgctttcgctaaggctttccctgagcttgttaggaaaaacgctgctcctatcatcccaactttcttcaggatggctgctatgtacgctaagtacggagttgttgacactgatgctaagaccttcactctcaaggaggctaaggctgctgctaagactaagtcatcttgatgattaatgaataattgattgtacatactatattttttgtttaccttgtgttagtttaatgttcagtgtcctctctttattgtggcacgtctctttgttgtatgttgtgtctatacaaagttgaaataatggaaagaaaaggaagagtgtaatttgttttgttttaagtgtttataaatatatatatataggtcatttagatagttctaggtttctataaaactctctctctggaagtagaatctgtttttgagaggatccagttgcctactaatctcccccaaaacccttcaagcttaaccttcctcttcacaacaacagaggaaacacatctcttgagctctgagttctcttctttgagcatgtctatcgctaaactcatctgccttatagcttccctcttctcttcatctctctctctcaccatttcgctgtaaaacttattctcctccctcagcctctctatctcttccttcagcatctcacaattcccaccataatcgactgaggatgattcaccgtcatcaacttcagactcagcgttgtagtcgtcatgagtctcacaagccttggaccaagaagactcatcatcgcaagttgatgatttatcatgatgcttctctgagccgtgtttgctagctagcctcagctgacgttacgtaacgctaggtagcgtcacgtgacgttagctaacgctaggtagcgtcagctgagcttacgtaagcgcttaattaaagtactgatatcggtaccaaatcgaatccaaaaattacggatatgaatataggcatatccgtatccgaattatccgtttgacagctagcaacgattgtacaattgcttctttaaaaaaggaagaaagaaagaaagaaaagaatcaacatcagcgttaacaaacggccccgttacggcccaaacggtcatatagagtaacggcgttaagcgttgaaagactcctatcgaaatacgtaaccgcaaacgtgtcatagtcagatcccctcttccttcaccgcctcaaacacaaaaataatcttctacagcctatatatacaacccccccttctatctctcctttctcacaattcatcatctttctttctctacccccaattttaagaaatcctctcttctcctcttcattttcaaggtaaatctctctctctctctctctctctgttattccttgttttaattaggtatgtattattgctagtttgttaatctgcttatcttatgtatgccttatgtgaatatctttatcttgttcatctcatccgtttagaagctataaatttgttgatttgactgtgtatctacacgtggttatgtttatatctaatcagatatgaatttcttcatattgttgcgtttgtgtgtaccaatccgaaatcgttgatttttttcatttaatcgtgtagctaattgtacgtatacatatggatctacgtatcaattgttcatctgtttgtgtttgtatgtatacagatctgaaaacatcacttctctcatctgattgtgttgttacatacatagatatagatctgttatatcattttttttattaattgtgtatatatatatgtgcatagatctggattacatgattgtgattatttacatgattttgttatttacgtatgtatatatgtagatctggactttttggagttgttgacttgattgtatttgtgtgtgtatatgtgtgttctgatcttgatatgttatgtatgtgcagctgaaccatggcggcggcaacaacaacaacaacaacatcttcttcgatctccttctccaccaaaccatctccttcctcctccaaatcaccattaccaatctccagattctccctcccattctccctaaaccccaacaaatcatcctcctcctcccgccgccgcggtatcaaatccagctctccctcctccatctccgccgtgctcaacacaaccaccaatgtcacaaccactccctctccaaccaaacctaccaaacccgaaacattcatctcccgattcgctccagatcaaccccgcaaaggcgctgatatcctcgtcgaggctttagaacgtcaaggcgtagaaaccgtattcgcttaccctggaggtacatcaatggagattcaccaagccttaacccgctcttcctcaatccgtaacgtccttcctcgtcacgaacaaggaggtgtattcgcagcagaaggatacgctcgatcctcaggtaaaccaggtatctgtatagccacttcaggtcccggagctacaaatctcgttagcggattagccgatgcgttgttagatagtgttcctcttgtagcaatcacaggacaagtccctcgtcgtatgattggtacagatgcgtttcaagagactccgattgttgaggtaacgcgttcgattacgaagcataactatcttgtgatggatgttgaagatatcccaaggattattgaagaggctttctttttagctacttctggtagacctggacctgttttggttgatgttcctaaagatattcaacaacagcttgcgattcctaattgggaacaggctatgagattacctggttatatgtctaggatgcctaaacctccggaagattctcatttggagcagattgttaggttgatttctgagtctaagaagcctgtgttgtatgttggtggtggttgtcttaattctagcgatgaattgggtaggtttgttgagcttacgggcatccctgttgcgagtacgttgatggggctgggatcttatccttgtgatgatgagttgtcgttacatatgcttggaatgcatgggactgtgtatgcaaattacgctgtggagcatagtgatttgttgttggcgtttggggtaaggtttgatgatcgtgtcacgggtaaacttgaggcttttgctagtagggctaagattgttcatattgatattgactcggctgagattgggaagaataagactcctcatgtgtctgtgtgtggtgatgttaagctggctttgcaagggatgaataaggttcttgagaaccgagcggaggagcttaaacttgattttggagtttggaggaatgagttgaacgtacagaaacagaagtttccgttgagctttaagacgtttggggaagctattcctccacagtatgcgattaaggtccttgatgagttgactgatggaaaagccataataagtactggtgtcgggcaacatcaaatgtgggcggcgcagttctacaattacaagaaaccaaggcagtggctatcatcaggaggccttggagctatgggatttggacttcctgctgcgattggagcgtctgttgctaaccctgatgcgatagttgtggatattgacggagatggaagttttataatgaatgtgcaagagctagccactattcgtgtagagaatcttccagtgaaggtacttttattaaacaaccagcatcttggcatggttatgcaatgggaagatcggttctacaaagctaaccgagctcacacatttctcggggacccggctcaggaggacgagatattcccgaacatgttgctgtttgcagcagcttgcgggattccagcggcgagggtgacaaagaaagcagatctccgagaagctattcagacaatgctggatacaccaggaccttacctgttggatgtgatttgtccgcaccaagaacatgtgttgccgatgatcccgaatggtggcactttcaacgatgtcataacggaaggagatggccggattaaatactgagagatgaaaccggtgattatcagaaccttttatggtctttgtatgcatatggtaaaaaaacttagtttgcaatttcctgtttgttttggtaatttgagtttcttttagttgttgatctgcctgctttttggtttacgtcagactactactgctgttgttgtttggtttcctttctttcattttataaataaataatccggttcggtttactccttgtgactggctcagtttggttattgcgaaatgcgaatggtaaattgagtaattgaaattcgttattagggttctaagctgttttaacagtcactgggttaatatctctcgaatcttgcatggaaaatgctcttaccattggtttttaattgaaatgtgctcatatgggccgtggtttccaaattaaataaaactacgatgtcatcgagaagtaaaatcaactgtgtccacattatcagttttgtgtatacgatgaaatagggtaattcaaaatctagcttgatatgccttttggttcattttaaccttctgtaaacattttttcagattttgaacaagtaaatccaaaaaaaaaaaaaaaaatctcaactcaacactaaattattttaatgtataaaagatgcttaaaacatttggcttaaaagaaagaagctaaaaacatagagaactcttgtaaattgaagtatgaaaatatactgaattgggtattatatgaatttttctgatttaggattcacatgatccaaaaaggaaatccagaagcactaatcagacattggaagtaggattaatcagtgatcagtaactattaaattcaattaaccgcggacatctacatttttgaattgaaaaaaaattggtaattactctttctttttctccatattgaccatcatactcattgctgatccatgtagatttcccggacatgaagccatttacaattgaatatatcctgccgccgctgccgctttgcacccggtggagcttgcatgttggtttctacgcagaactgagccggttaggcagataatttccattgagaactgagccatgtgcaccttccccccaacacggtgagcgacggggcaacggagtgatccacatgggacttttaaacatcatccgtcggatggcgttgcgagagaagcagtcgatccgtgagatcagtcgaccaattctcatgtttgacagcttatcatcgaatttctgccattcatccgcttattatcacttattcaggcgtagcaaccaggcgtttaagggcaccaataactgccttaaaaaaattacgccccgccctgccactcatcgcagtactgttgtaattcattaagcattctgccgacatggaagccatcacaaacggcatgatgaacctgaatcgccagcggcatcagcaccttgtcgccttgcgtataatatttgcccatggtgaaaacgggggcgaagaagttgtccatattggccacgtttaaatcaaaactggtgaaactcacccagggattggctgagacgaaaaacatattctcaataaaccctttagggaaataggccaggttttcaccgtaacacgccacatcttgcgaatatatgtgtagaaactgccggaaatcgtcgtggtattcactccagagcgatgaaaacgtttcagtttgctcatggaaaacggtgtaacaagggtgaacactatcccatatcaccagctcaccgtctttcattgccatacggaattccggatgagcattcatcaggcgggcaagaatgtgaataaaggccggataaaacttgtgcttatttttctttacggtctttaaaaaggccgtaatatccaggacctgcaggggggggggggcgctgaggtctgcctcgtgaagaaggtgttgctgactcataccaggcctgaatcgccccatcatccagccagaaagtgagggagccacggttgatgagagctttgttgtaggtggaccagttggtgattttgaacttttgctttgccacggaacggtctgcgttgtcgggaagatgcgtgatctgatccttcaactcagcaaaagttcgatttattcaacaaagccgccgtcccgtcaagtcagcgtaatgctctgccagtgttacaaccaattaaccaattctgattagaaaaactcatcgagcatcaaatgaaactgcaatttattcatatcaggattatcaataccatatttttgaaaaagccgtttctgtaatgaaggagaaaactcaccgaggcagttccataggatggcaagatcctggtatcggtctgcgattccgactcgtccaacatcaatacaacctattaatttcccctcgtcaaaaataaggttatcaagtgagaaatcaccatgagtgacgactgaatccggtgagaatggcaaaagcttatgcatttctttccagacttgttcaacaggccagccattacgctcgtcatcaaaatcactcgcatcaaccaaaccgttattcattcgtgattgcgcctgagcgagacgaaatacgcgatcgctgttaaaaggacaattacaaacaggaatcgaatgcaaccggcgcaggaacactgccagcgcatcaacaatattttcacctgaatcaggatattcttctaatacctggaatgctgttttcccggggatcgcagtggtgagtaaccatgcatcatcaggagtacggataaaatgcttgatggtcggaagaggcataaattccgtcagccagtttagtctgaccatctcatctgtaacatcattggcaacgctacctttgccatgtttcagaaacaactctggcgcatcgggcttcccatacaatcgatagattgtcgcacctgattgcccgacattatcgcgagcccatttatacccatataaatcagcatccatgttggaatttaatcgcggcctcgagcaagacgtttcccgttgaatatggctcataacaccccttgtattactgtttatgtaagcagacagttttattgttcatgatgatatatttttatcttgtgcaatgtaacatcagagattttgagacacaacgtggctttcccccccccccctgcaggtcctgaacggtctggttataggtacattgagcaactgactgaaatgcctcaaaatgttctttacgatgccattgggatatatcaacggtggtatatccagtgatttttttctccattttagcttccttagctcctgaaaatctcgataactcaaaaaatacgcccggtagtgatcttatttcattatggtgaaagttggaacctcttacgtgccgatcaacgtctcattttcgccaaaagttggcccagggcttcccggtatcaacagggacaccaggatttatttattctgcgaagtgatcttccgtcacaggtatttattcgcgataagctcatggagcggcgtaaccgtcgcacaggaaggacagagaaagcgcggatctgggaagtgacggacagaacggtcaggacctggattggggaggcggttgccgccgctgctgctgacggtgtgacgttctctgttccggtcacaccacatacgttccgccattcctatgcgatgcacatgctgtatgccggtataccgctgaaagttctgcaaagcctgatgggacataagtccatcagttcaacggaagtctacacgaaggtttttgcgctggatgtggctgcccggcaccgggtgcagtttgcgatgccggagtctgatgcggttgcgatgctgaaacaattatcctgagaataaatgccttggcctttatatggaaatgtggaactgagtggatatgctgtttttgtctgttaaacagagaagctggctgttatccactgagaagcgaacgaaacagtcgggaaaatctcccattatcgtagagatccgcattattaatctcaggagcctgtgtagcgtttataggaagtagtgttctgtcatgatgcctgcaagcggtaacgaaaacgatttgaatatgccttcaggaacaatagaaatcttcgtgcggtgttacgttgaagtggagcggattatgtcagcaatggacagaacaacctaatgaacacagaaccatgatgtggtctgtccttttacagccagtagtgctcgccgcagtcgagcgacagggcgaagccctcgagtgagcgaggaagcaccagggaacagcacttatatattctgcttacacacgatgcctgaaaaaacttcccttggggttatccacttatccacggggatatttttataattattttttttatagtttttagatcttcttttttagagcgccttgtaggcctttatccatgctggttctagagaaggtgttgtgacaaattgccctttcagtgtgacaaatcaccctcaaatgacagtcctgtctgtgacaaattgcccttaaccctgtgacaaattgccctcagaagaagctgttttttcacaaagttatccctgcttattgactcttttttatttagtgtgacaatctaaaaacttgtcacacttcacatggatctgtcatggcggaaacagcggttatcaatcacaagaaacgtaaaaatagcccgcgaatcgtccagtcaaacgacctcactgaggcggcatatagtctctcccgggatcaaaaacgtatgctgtatctgttcgttgaccagatcagaaaatctgatggcaccctacaggaacatgacggtatctgcgagatccatgttgctaaatatgctgaaatattcggattgacctctgcggaagccagtaaggatatacggcaggcattgaagagtttcgcggggaaggaagtggttttttatcgccctgaagaggatgccggcgatgaaaaaggctatgaatcttttccttggtttatcaaacgtgcgcacagtccatccagagggctttacagtgtacatatcaacccatatctcattcccttctttatcgggttacagaaccggtttacgcagtttcggcttagtgaaacaaaagaaatcaccaatccgtatgccatgcgtttatacgaatccctgtgtcagtatcgtaagccggatggctcaggcatcgtctctctgaaaatcgactggatcatagagcgttaccagctgcctcaaagttaccagcgtatgcctgacttccgccgccgcttcctgcaggtctgtgttaatgagatcaacagcagaactccaatgcgcctctcatacattgagaaaaagaaaggccgccagacgactcatatcgtattttccttccgcgatatcacttccatgacgacaggatagtctgagggttatctgtcacagatttgagggtggttcgtcacatttgttctgacctactgagggtaatttgtcacagttttgctgtttccttcagcctgcatggattttctcatactttttgaactgtaatttttaaggaagccaaatttgagggcagtttgtcacagttgatttccttctctttcccttcgtcatgtgacctgatatcgggggttagttcgtcatcattgatgagggttgattatcacagtttattactctgaattggctatccgcgtgtgtacctctacctggagtttttcccacggtggatatttcttcttgcgctgagcgtaagagctatctgacagaacagttcttctttgcttcctcgccagttcgctcgctatgctcggttacacggctgcggcgagcgctagtgataataagtgactgaggtatgtgctcttcttatctccttttgtagtgttgctcttattttaaacaactttgcggttttttgatgactttgcgattttgttgttgctttgcagtaaattgcaagatttaataaaaaaacgcaaagcaatgattaaaggatgttcagaatgaaactcatggaaacacttaaccagtgcataaacgctggtcatgaaatgacgaaggctatcgccattgcacagtttaatgatgacagcccggaagcgaggaaaataacccggcgctggagaataggtgaagcagcggatttagttggggtttcttctcaggctatcagagatgccgagaaagcagggcgactaccgcacccggatatggaaattcgaggacgggttgagcaacgtgttggttatacaattgaacaaattaatcatatgcgtgatgtgtttggtacgcgattgcgacgtgctgaagacgtatttccaccggtgatcggggttgctgcccataaaggtggcgtttacaaaacctcagtttctgttcatcttgctcaggatctggctctgaaggggctacgtgttttgctcgtggaaggtaacgacccccagggaacagcctcaatgtatcacggatgggtaccagatcttcatattcatgcagaagacactctcctgcctttctatcttggggaaaaggacgatgtcacttatgcaataaagcccacttgctggccggggcttgacattattccttcctgtctggctctgcaccgtattgaaactgagttaatgggcaaatttgatgaaggtaaactgcccaccgatccacacctgatgctccgactggccattgaaactgttgctcatgactatgatgtcatagttattgacagcgcgcctaacctgggtatcggcacgattaatgtcgtatgtgctgctgatgtgctgattgttcccacgcctgctgagttgtttgactacacctccgcactgcagtttttcgatatgcttcgtgatctgctcaagaacgttgatcttaaagggttcgagcctgatgtacgtattttgcttaccaaatacagcaatagtaatggctctcagtccccgtggatggaggagcaaattcgggatgcctggggaagcatggttctaaaaaatgttgtacgtgaaacggatgaagttggtaaaggtcagatccggatgagaactgtttttgaacaggccattgatcaacgctcttcaactggtgcctggagaaatgctctttctatttgggaacctgtctgcaatgaaattttcgatcgtctgattaaaccacgctgggagattagataatgaagcgtgcgcctgttattccaaaacatacgctcaatactcaaccggttgaagatacttcgttatcgacaccagctgccccgatggtggattcgttaattgcgcgcgtaggagtaatggctcgcggtaatgccattactttgcctgtatgtggtcgggatgtgaagtttactcttgaagtgctccggggtgatagtgttgagaagacctctcgggtatggtcaggtaatgaacgtgaccaggagctgcttactgaggacgcactggatgatctcatcccttcttttctactgactggtcaacagacaccggcgttcggtcgaagagtatctggtgtcatagaaattgccgatgggagtcgccgtcgtaaagctgctgcacttaccgaaagtgattatcgtgttctggttggcgagctggatgatgagcagatggctgcattatccagattgggtaacgattatcgcccaacaagtgcttatgaacgtggtcagcgttatgcaagccgattgcagaatgaatttgctggaaatatttctgcgctggctgatgcggaaaatatttcacgtaagattattacccgctgtatcaacaccgccaaattgcctaaatcagttgttgctcttttttctcaccccggtgaactatctgcccggtcaggtgatgcacttcaaaaagcctttacagataaagaggaattacttaagcagcaggcatctaaccttcatgagcagaaaaaagctggggtgatatttgaagctgaagaagttatcactcttttaacttctgtgcttaaaacgtcatctgcatcaagaactagtttaagctcacgacatcagtttgctcctggagcgacagtattgtataagggcgataaaatggtgcttaacctggacaggtctcgtgttccaactgagtgtatagagaaaattgaggccattcttaaggaacttgaaaagccagcaccctgatgcgaccacgttttagtctacgtttatctgtctttacttaatgtcctttgttacaggccagaaagcataactggcctgaatattctctctgggcccactgttccacttgtatcgtcggtctgataatcagactgggaccacggtcccactcgtatcgtcggtctgattattagtctgggaccacggtcccactcgtatcgtcggtctgattattagtctgggaccacggtcccactcgtatcgtcggtctgataatcagactgggaccacggtcccactcgtatcgtcggtctgattattagtctgggaccatggtcccactcgtatcgtcggtctgattattagtctgggaccacggtcccactcgtatcgtcggtctgattattagtctggaaccacggtcccactcgtatcgtcggtctgattattagtctgggaccacggtcccactcgtatcgtcggtctgattattagtctgggaccacgatcccactcgtgttgtcggtctgattatcggtctgggaccacggtcccacttgtattgtcgatcagactatcagcgtgagactacgattccatcaatgcctgtcaagggcaagtattgacatgtcgtcgtaacctgtagaacggagtaacctcggtgtgcggttgtatgcctgctgtggattgctgctgtgtcctgcttatccacaacattttgcgcacggttatgtggacaaaatacctggttacccaggccgtgccggcacgtttcctacaaggtagaatccgcctgagtcgcaagggtgacttcgcctatattggacgacggcgcgcagagggcgacctctttttgggttacgattgtaggattatcactaaaacaatacatgaacatattcaaatggcaatctctctaaggcattggaaataaatacaaataacagttgggtggagtttttcgacctgagggcgttaactcttcaaggacaacaagaccgtggacgtcgagcggctctccgacaagcatgtcgcccgcctggtcaagcagaccgcactcgccgccggcgcttcgataccgttcgtattggtccggcgaaactgtgagtatccgcatcgtaatctccgcatgaacaggtcatgcgaacagaaatcatctcacggtgcgtttgcctacgtgcagatttgcacctcaggtgattctaccgagtcggtgttccaaggcgcgaaatgcgagcgggtgaggccgaccagacgccgacaaggttgtgcagatctgcacttggtgccacgtcgcacagaagaagggaatcggtctaactcacagatagcatttgaagaatcgggatttagtgtgatttcgattgaaacgcgcgtaaccgttcattaaccaaaaacgtcttgcaacctcacccgcattaggtaatcgtcacggataaatggcaatacgcgccaattaaccgtgacaagagataacaccgtgagcaaagccgctgccatatcccgaaatgatcgcccgtcggtagatgttaccattggtgagcatgctgagcagctcagctctcagcttcaagcgatgagcgaggctttgtttcctccgacgtcgcacaagagcttgcgcaaattcacctcgggtgaagccgcacgcttgatgaaaatatctgactcaactcttcgaaagatgacactggctggcgaagggccgcaacctgaactcgccagcaacggacggcgcttttacaccctcggtcagataaacgaaatccggcagatgcttgccggctcgactcgaggacgtgaaagcattgattttgtgcctcatcgccgaggttctgagcatttgcaagtcgttgctgtaaccaacttcaaaggtggctctgggaagacgacgacgtccgctcatcttgcacagtatctggcgttgcaaggttacagggttctcgcagtcgatctcgatccgcaggctagtctttcagcactcctcggcgttctgccagaaactgatgtcggtgcaaacgaaacgctctatgcggctattcggtacgacgacacacgtcgtccgttgcgagatgtgatccgaccgacgtattttgatggtcttcaccttgttcctggaaatctcgagcttatggagttcgagcataccaccccgaaagcattgactgacaaaggtacgcgcgacggattgttcttcactcgcgtggcccaagcctttgatgaggtcgccgacgattacgatgtcgtggtcatcgactgccctcctcagcttgggtttttgactctcagcgggttgtgtgctgcaacatcaatggtaatcaccgtacatcctcagatgctggatatcgcttccatgagccagtttctcctcatgacacgcgaccttctgggtgtcgtgaaagaggcggggggcaatctccagtacgatttcatacgctatctcttgacgcgctatgagccccaggacgcgccgcagacgaaagtgacggcactgctgcgcaacatgttcgaggatcacgtccttacaaatcctatggtcaagtcggcagcggtatctgatgccggtttaaccaagcagacgctctatgagatagggcgagagaaccttacgcgatcgacatacgaccgggcgatggaatctttagatgcggtgaattcggagatcgaggctttgatcaagatggcgtgggggcgggtctaatgaaaggctttgcgttcctcacagatctgttgggagctcccaacagacaggtgttgattcgccccctggacatggggcactggagaagccggggtaatttgagacgacgacgcacgcccatcgctaattggccagggtgcagttgtcttgtcttgttgggagctcccaaccaagcgcatttgcaatcaaaaatgcgacgccacgacgccaaacccaagaggccgatatcatgagccgcaaagacgcaatcgatactttgttcctcaagaagcaacctgcgaccgatagagcagcagtcgacaagtcgaccgctcgtgttcgtaccggagcgatttcggccatgggttcgtctttgcaagagatggctgagggcgcaaaggctgcagctcggctgcaggatcaactggctacaggcgaagccgtcgtgtccctggatccatccatgatcgacgggtcgccgatcgcggatcggctgccctcagacgtggatccgaaattcgagcagcttgaggcgagcatttcgcaggaggggcagcaggtgccggttcttgtcagaccgcaccctgaggctgccggtcgatatcagatcgtatatggaaggcggcggctgcgcgcggcagtaaatctgcggagagaggtttctgccattgttcgaaatctcacggactgtgaactggtcgtggcccagggccgcgaaaatcttaaccgcgctgacctctcgttcattgagaaggctctcttcgccctgcgcctcgaagatgcgggttttgatagagccaccatcattgccgcgctatccactgacaaggccgacctcagccgctacataactgtagcaaggggcataccgctgaacctcgccacacaaatcggcccagcgtcgaaagcgggtcgatcgcgttgggtcgtacttgccgaggggcttgggaagcctaaggcaacggacgcaatcgaagcgatgcttgggtcagagcagttcaagcaatctgatagcgatacccgctttaacctcattttcaacgccgtttcaaggccacctgcgaagactccaaaaaaggtaagggcctggagcacgccaaaggggaaaaaggcagcgacgatccgacaagaaactggacgaacggcgctggttttcgacgagagactggtgccaacttttggcgaatatgtcgctgaccagttggacagtctgtacgcccagttcattgaaaccaacggaggaggcaagctcgaccaatagtcagggtttcatccaatttaaagctccgctcgactgagatggactggctctcaccgcaaaagaaaaaggcccccgaaacggcgttccggaagaccttctctgtagtctcgcagctaagagaatcgcatttccaggaatcgtagtcaagggtcccgtaagggaaagcgtcatttcgacgggcggatttcaattgcctaacaaaaggtaaaaggaaatgcagacgcatatctcaacgacgtcctttgggcggcggccgatgacactcggccatattgcaagccagatggcagcaaaagcggtcgcatcagacactgtcgcccacaaatggcaggtcttccagcacatccgtgaatcccggggactgatcggagccacggaccgctcactctcgatcctgaacgcgctgttgacgttttacccggagaccgccttgactggtggtgccgaactggtcgtatggccttctaacgaacagctgatggctcgcgccaacggcatgcccgccacgacactgcgccggcatcttgccatactggttgattgcgggctcatcattcgccgcgacagccccaatggcaagcggttcgcccgcaagggaaggggaggggagattgagcaggcctatgggttcgatctgtcgccgatcgtcgcgcgggccgaggagttccgagatctggcccagacagtgcaagctgaaaaaaaggccttccgggtggccaaggagcgcttgactcttcttcgtcgtgacattgtcaaaatgatcgaaactggcgtcgaagagagcgttcctggaaactggggaagagttacccagacctatcaggggatcatcggccgcctgccacgctcggcacctcggcagcttgtcgagagtattgggcaagagcttcaggaactctgcatcgagatccgtgacgtattggaatctttcacaaaaacgatgaatctggacgccaatgagtcccatatcggtcgccacaaacagaattcaaatccagactctaaatttgaatctgaatacagctctggaaaaaaagatgaagcgggcggcagcgttgcggaaaccgacaatgtacggagcttgccgaaacgcgagctgcctttgggaatcgtgctggatgcctgccccgaaatgcgggaattggcccagggaggtccaattcggcattggcgcgacttgctggcggcggctgagcttgcccggccgatgctggggattagtccgagcgcctggcgggaggcccgcgaaaccatgggcgatcaacacgcggcgatcacgctggcttcgatctatcagcgggccggtcagatcaataacgctgggggctatctgcgcagcctgaccgaccgggccaaggatgggaagttttcgacctggccgatggtcatggcgttgctccgggcaaagctggacgagcagaagaatgcagttggcgctggaaagccgcgaactgctgaggaggtcgaggatgacagccgcctccacgtatcggaatcgctgctcaaaaacctgcgaaagccgagatcttggtgatcctctcgctattcagccgcggcgatgtcgacgtcggtgatcaacccggaacgtcgggcgcggtcgatcaggttcttgacggacgagggcgcccatttggatccaccgcgcggcgtgcgctcgtgcagtctttcaagctggccggcgatctcgcggagcttcaggtctgggttcgaagaatggatgccggccacaagcgtcatcaggcgatcttcgggaagacggggaggagattttttcaggagcgctgcatccaccaggcgttccgtcaccatccacttcacggctcggcgaagacgttctggcgtccagtcgaggccccgctgcttgagcattcgggcgatgtcgtcccatgtgtgatccggtcgcatgcgacgaacggtaggaagccattggttcgcggacgcctgaatcctatcgccatatgccgctttctgggccgcggtcatccttgccagcgcctccgggcgcttttcccggatgcccgggttgccggaaagcttccctaggcacaaacgttgactcttggatcgagctggcagacaaagcaataacccacacagaggacgattaatggctgacgaagagatccagaatccgccggacggtactgctgctgccgaagttgagccggctgctcctagaggtagaagagcaaagaaagcaccagccgaaacagcccgcacgggatcgttcaaatccgtgaagccgaaaacccgcggcctcagcaaccgagaaaaactggagaagatcggtcaaatcgaagctcaggtcgctggcggcgcaaccttgaaggacgccgttaagatcgtgggtatttccgttcagacctattatcaatggaagagagctgcggttcaacctgtctcacagaatccggccgtgtctgtttcagttgacgatgaactcggcgagttcatccaactcgaggaggaaaatcggcggctcagaaagcttcacgctgccgcaagcactcagggcgcaagggctgctaaaggaagcggaacacgtagaaagccagtccgcagaaacggtgctgaccccggatgaatgtcagctactgggctatctggacaagggaaaacgcaagcgcaaagagaaagcaggtagcttgcagtgggcttacatggcgatagctagactgggcggttttatggacagcaagcgaaccggaattgccagctggggcgccctctgggaaggttgggaagccctgcaaagtaaactggatggctttcttgccgccaaggatctgatggcgcaggggatcaagatctgatcaagagacaggggccggcccacgctgtcgtccaatctcccaagacacgccgccaccgcgcaccgtcgcggcgagctgctccccaagccgctgttcgatgggcttccaccgcacgaggctggaccccttggcgtcatcaagcatcccatttcgcccgctggcgagcatgacggggcgccggtagacgccggcaacgcgctggccgtcggccacggggcgatgctccaggccggtatcggcggcaatgtccttcgcggcctgcgccagttcccgagcccgctgctgcccagcagattccggtgaggatcacgcgctgcccgcgccgctcggccagtccctgttcggccaggaagtccgcgcgctgctgtatcgcctacttggcctcactgctaaagcccaggtcgcccaagcccgagccaccgtcgatcaactgctggtcaagccaggtggcaccgatcacgcgggcctgccgctcgatgggcaggtgcgatttcagctccaccgtcacgccaccaagacgctgggcgtcatagcggcggccctgctcgggcagatcgtccggcaccttccatagtccctcggccacgcacaccacgatgccggcctggtgcagggcttcgaggcggcgggtgtggcccgcaacgacttccagcggatcacgcccgacacggcctgacctagctcgacgaccaggtgagatcggtgaccgcgctagtcaagcaaccggcgtgccatggcgtttacggccagatcaatcgcagcgccctcgccctcgccgtcgccgtcgccgatgaaccaggctgccgacaagcccgtccatgcaatgatccagcgaagaagccgttcgggctcaaacccggtcgtcgcgaccacaatgctgagtcgagcctccagcctgcccggcaggatcgcaagcgggcgaccggggtcgctgagatcgggattcgtgaagatgttggcatagtcgaaggtgcgctcgccgagcagtccgtgcgggtcgatggccagccagccgcggtcgccgaagtcgagcacgttctcgtggtgcaggtcgccgtggagcgggcacacctcgcgcggcgccgccagaagttggcgcgctacgctggcggcgggcgcaagtgccgcgtgctcagcggccaaccggaaaagcggctggaaccattcctgtagcggatggagatcgggcggcggtccggaccgcggcgcgtgcagacgagcggcggtgtcgcagaggatcgtggcatcaccgaaccgcgccgtgcgcgggtcgtcggtgagccagagtttcagcaggccgcccaggcggcccaggtcgccattgatgcgggccagctcgcggacgtgctcatagtccacgacgcccgtgattttgtagccctggccgacggccagcaggtaggccgacaggctcatgccggccgccgccgccttttcctcaatcgctcttcgttcgtctggaaggcagtacaccttgataggtgggctgcccttcctggttggcttggtttcatcagccatccgcttgccctcatctgttacgccggcggtagccggccagcctcgcagagcaggattcccgttgagcaccgccaggtgcgaataagggacagtgaagaaggaacacccgctcgcgggtgggcctacttcacctatcctgcccggctgacgccgttggatacaccaaggaaagtctacacgaaccctttggcaaaatcctgtatatcgtgcgaaaaaggatggatataccgaaaaaatcgctataatgaccccgaagcagggttatgcagcggaaaagcgctgcttccctgctgttttgtggaatatctaccgactggaaacaggcaaatgcaggaaattactgaactgaggggacaggcgagagacgatgccaaagagctacaccgacgagctggccgagtgggttgaatcccgcgcggccaagaagcgccggcgtgatgaggctgcggttgcgttcctggcggtgagggcggatgtcgaggcggcgttagcgtccggctatgcgctcgtcaccatttgggagcacatgcgggaaacggggaaggtcaagttctcctacgagacgttccgctcgcacgccaggcggcacatcaaggccaagcccgccgatgtgcccgcaccgcaggccaaggctgcggaacccgcgccggcacccaagacgccggagccacggcggccgaagcaggggggcaaggctgaaaagccggcccccgctgcggccccgaccggcttcaccttcaacccaacaccggacaaaaaggatcaaccgggctgcatccgatgcaagtgtgtcgctgtcgactcgttgtacaacgaaatccattcccattccgcgctcaagatggcttcccctcggcagttcatcagggctaaatcaatctagccgacttgtccggtgaaatgggctgcactccaacagaaacaatcaaacaaacatacacagcgacttattcacacgagctcaaattacaacggtatatat

SEQ ID NO: 3 - DNA, 60074 bp, Artificial Sequence
  plasmid
cctgccagtcagcatcatcacaccaaaagttaggcccgaatagtttgaaattagaaagctcgcaattgaggtctacaggccaaattcgctcttagccgtacaatattactcaccggtgcgatgccccccatcgtaggtgaaggtggaaattaatggcgcgcctgatcactgattagtaactattacgtaagcctacgtagcgtcacgtgacgttagctaacgctacgtagcctcagctgacgttacgtaagcctacgtagcgtcacgtgagcttagctaacgctacctaggctcagctgacgttacgtaacgctagctagcgtcactcctgcagcaaatttacacattgccactaaacgtctaaacccttgtaatttgtttttgttttactatgtgtgttatgtatttgatttgcgataaatttttatatttggtactaaatttataacaccttttatgctaacgtttgccaacacttagcaatttgcaagttgattaattgattctaaattatttttgtcttctaaatacatatactaatcaactggaaatgtaaatatttgctaatatttctactataggagaattaaagtgagtgaatatggtaccacaaggtttggagatttaattgttgcaatgctgcatggatggcatatacaccaaacattcaataattcttgaggataataatggtaccacacaagatttgaggtgcatgaacgtcacgtggacaaaaggtttagtaatttttcaagacaacaatgttaccacacacaagttttgaggtgcatgcatggatgccctgtggaaagtttaaaaatattttggaaatgatttgcatggaagccatgtgtaaaaccatgacatccacttggaggatgcaataatgaagaaaactacaaatttacatgcaactagttatgcatgtagtctatataatgaggattttgcaatactttcattcatacacactcactaagttttacacgattataatttcttcatagccagtactgtttaagcttcactgtctctgaatcggcaaaggtaaacgtatcaattattctacaaacccttttatttttcttttgaattaccgtcttcattggttatatgataacttgataagtaaagcttcaataattgaatttgatctgtgtttttttggccttaatactaaatccttacataagctttgttgcttctcctcttgtgagttgagtgttaagttgtaataatggttcactttcagctttagaagaaaccatggaagttgttgagaggttctacggagagttggatggaaaggtttcccaaggagtgaacgctttgttgggatctttcggagttgagttgactgataccccaactactaagggattgccactcgttgattctccaactccaattgtgttgggagtgtctgtttacttgaccatcgtgatcggaggattgctttggatcaaggctagagatctcaagccaagagcttctgagccattcttgttgcaagctttggtgttggtgcacaacttgttctgcttcgctttgtctctttacatgtgcgtgggtatcgcttaccaagctatcacctggagatattccttgtggggaaacgcttataacccaaagcacaaggagatggctatcctcgtttacctcttctacatgtccaagtacgtggagttcatggataccgtgatcatgatcctcaagagatccaccagacagatttctttcctccacgtgtaccaccactcttctatctcccttatctggtgggctattgctcaccacgctccaggaggagaggcttattggagtgctgctctcaactctggagtgcacgtgttgatgtacgcttactacttcttggctgcttgcttgagatcttccccaaagctcaagaacaagtacctcttctggggaagatacctcacccaattccagatgttccagttcatgctcaacttggtgcaagcttactacgatatgaaaaccaacgctccatatccacaatggctcatcaagatcctcttctactacatgatctccctcttgttcctcttcggaaacttctacgtgcaaaagtacatcaagccatccgatggaaagcaaaagggagctaagaccgagtgatcgacaagctcgagtttctccataataatgtgtgagtagttcccagataagggaattagggttcctatagggtttcgctcatgtgttgagcatataagaaacccttagtatgtatttgtatttgtaaaatacttctatcaataaaatttctaattcctaaaaccaaaatccagtactaaaatccagatcccccgaattaattcggcgttaattcagctagctagcctcagctgacgttacgtaacgctaggtagcgtcacgtgacgttagctaacgctaggtagcgtcagctgagcttacgtaagcgcttagcagatatttggtgtctaaatgtttattttgtgatatgttcatgtttgaaatggtggtttcgaaaccagggacaacgttgggatctgatagggtgtcaaagagtattatggattgggacaatttcggtcatgagttgcaaattcaagtatatcgttcgattatgaaaattttcgaagaatatcccatttgagagagtctttacctcattaatgtttttagattatgaaattttatcatagttcatcgtagtctttttggtgtaaaggctgtaaaaagaaattgttcacttttgttttcgtttatgtgaaggctgtaaaagattgtaaaagactattttggtgttttggataaaatgatagtttttatagattcttttgcttttagaagaaatacatttgaaattttttccatgttgagtataaaataccgaaatcgattgaagatcatagaaatattttaactgaaaacaaatttataactgattcaattctctccatttttatacctatttaaccgtaatcgattctaatagatgatcgattttttatataatcctaattaaccaacggcatgtattggataattaaccgatcaactctcacccctaatagaatcagtattttccttcgacgttaattgatcctacactatgtaggtcatatccatcgttttaatttttggccaccattcaattctgtcttgcctttagggatgtgaatatgaacggccaaggtaagagaataaaaataatccaaattaaagcaagagaggccaagtaagataatccaaatgtacacttgtcattgccaaaattagtaaaatactcggcatattgtattcccacacattattaaaataccgtatatgtattggctgcatttgcatgaataatactacgtgtaagcccaaaagaacccacgtgtagcccatgcaaagttaacactcacgaccccattcctcagtctccactatataaacccaccatccccaatctcaccaaacccaccacacaactcacaactcactctcacaccttaaagaaccaatcaccaccaaaaaatttcacgatttggaatttgattcctgcgatcacaggtatgacaggttagattttgttttgtatagttgtatacatacttctttgtgatgttttgtttacttaatcgaatttttggagtgttttaaggtctctcgtttagaaatcgtggaaaatatcactgtgtgtgtgttcttatgattcacagtgtttatgggtttcatgttctttgttttatcattgaatgggaagaaatttcgttgggatacaaatttctcatgttcttactgatcgttattaggagtttggggaaaaaggaagagtttttttggttggttcgagtgattatgaggttatttctgtatttgatttatgagttaatggtcgttttaatgttgtagaccatgggaaaaggatctgagggaagatctgctgctagagagatgactgctgaggctaacggagataagagaaagaccatcctcattgagggagtgttgtacgatgctaccaacttcaaacacccaggaggttccattattaacttcctcaccgagggagaagctggagttgatgctacccaagcttacagagagttccatcagagatccggaaaggctgataagtacctcaagtccctcccaaagttggatgcttctaaggtggagtctaggttctctgctaaggagcaggctagaagggacgctatgaccagggattacgctgctttcagagaggagttggttgctgagggatacttcgatccatctatcccacacatgatctacagagtggtggagattgtggctttgttcgctttgtctttctggttgatgtctaaggcttctccaacctctttggttttgggagtggtgatgaacggaatcgctcaaggaagatgcggatgggttatgcacgagatgggacacggatctttcactggagttatctggctcgatgataggatgtgcgagttcttctacggagttggatgtggaatgtctggacactactggaagaaccagcactctaagcaccacgctgctccaaacagattggagcacgatgtggatttgaacaccttgccactcgttgctttcaacgagagagttgtgaggaaggttaagccaggatctttgttggctttgtggctcagagttcaggcttatttgttcgctccagtgtcttgcttgttgatcggattgggatggaccttgtacttgcacccaagatatatgctcaggaccaagagacacatggagtttgtgtggatcttcgctagatatatcggatggttctccttgatgggagctttgggatattctcctggaacttctgtgggaatgtacctctgctctttcggacttggatgcatctacatcttcctccaattcgctgtgtctcacacccacttgccagttaccaacccagaggatcaattgcactggcttgagtacgctgctgatcacaccgtgaacatctctaccaagtcttggttggttacctggtggatgtctaacctcaacttccaaatcgagcaccacttgttcccaaccgctccacaattcaggttcaaggagatctctccaagagttgaggctctcttcaagagacacaacctcccttactacgatttgccatacacctctgctgtttctactaccttcgctaacctctactctgttggacactctgttggagctgataccaagaagcaggattgactgctttaatgagatatgcgagacgcctatgatcgcatgatatttgctttcaattctgttgtgcacgttgtaaaaaacctgagcatgtgtagctcagatccttaccgccggtttcggttcattctaatgaatatatcacccgttactatcgtatttttatgaataatattctccgttcaatttactgattgtctacgtaggctcagctgagcttacctaaggctacgtaggctcacgtgacgttacgtaaggctacgtagcgtcacgtgagcttacctaactctagctagcctcacgtgaccttagctaacactaggtagcgtcagctcgacggcccggactgtatccaacttctgatctttgaatctctctgttccaacatgttctgaaggagttctaagacttttcagaaagcttgtaacatgctttgtagactttctttgaattactcttgcaaactctgattgaacctacgtgaaaactgctccagaagttctaaccaaattccgtcttgggaaggcccaaaatttattgagtacttcagtttcatggacgtgtcttcaaagatttataacttgaaatcccatcatttttaagagaagttctgttccgcaatgtcttagatctcattgaaatctacaactcttgtgtcagaagttcttccagaatcaacttgcatcatggtgaaaatctggccagaagttctgaacttgtcatatttcttaacagttagaaaaatttctaagtgtttagaattttgacttttccaaagcaaacttgacttttgactttcttaataaaacaaacttcatattctaacatgtcttgatgaaatgtgattcttgaaatttgatgttgatgcaaaagtcaaagtttgacttttcagtgtgcaattgaccattttgctcttgtgccaattccaaacctaaattgatgtatcagtgctgcaaacttgatgtcatggaagatcttatgagaaaattcttgaagactgagaggaaaaattttgtagtacaacacaaagaatcctgtttttcatagtcggactagacacattaacataaaacaccacttcattcgaagagtgattgaagaaggaaatgtgcagttacctttctgcagttcataagagcaacttacagacacttttactaaaatactacaaagaggaagattttaacaacttagagaagtaatgggagttaaagagcaacacattaagggggagtgttaaaattaatgtgttgtaaccaccactacctttagtaagtattataagaaaattgtaatcatcacattataattattgtccttatttaaaattatgataaagttgtatcattaagattgagaaaaccaaatagtcctcgtcttgatttttgaattattgttttctatgttacttttcttcaagcctatataaaaactttgtaatgctaaattgtatgctggaaaaaaatgtgtaatgaattgaatagaaattatggtatttcaaagtccaaaatccatcaatagaaatttagtacaaaacgtaactcaaaaatattctcttattttaaattttacaacaatataaaaatattctcttattttaaattttacaataatataatttatcacctgtcacctttagaataccaccaacaatattaatacttagatattttattcttaataattttgagatctctcaatatatctgatatttattttatatttgtgtcatattttcttatgttttagagttaacccttatatcttggtcaaactagtaattcaatatatgagtttgtgaaggacacattgacatcttgaaacattggttttaaccttgttggaatgttaaaggtaataaaacattcagaattatgaccatctattaatatacttcctttgtcttttaaaaaagtgtgcatgaaaatgctctatggtaagctagagtgtcttgctggcctgtgtatatcaattccatttccagatggtagaaactgccactacgaataattagtcataagacacgtatgttaacacacgtccccttgcatgttttttgccatatattccgtctctttctttttcttcacgtataaaacaatgaactaattaatagagcgatcaagctgaacagttctttgctttcgaagttgccgcaacctaaacaggtttttccttcttctttcttcttattaactacgaccttgtcctttgcctatgtaaaattactaggttttcatcagttacactgattaagttcgttatagtggaagataaaatgccctcaaagcattttgcaggatatctttgatttttcaaagatatggaactgtagagtttgatagtgttcttgaatgtggttgcatgaagtttttttggtctgcatgttattttttcctcgaaatatgttttgagtccaacaagtgattcacttgggattcagaaagttgttttctcaatatgtaacagtttttttctatggagaaaaatcatagggaccgttggttttggcttctttaattttgagctcagattaaacccattttacccggtgttcttggcagaattgaaaacagtacgtagtaccgcgcctaccatgtgtgttgagaccgagaacaacgatggaatccctactgtggagatcgctttcgatggagagagagaaagagctgaggctaacgtgaagttgtctgctgagaagatggaacctgctgctttggctaagaccttcgctagaagatacgtggttatcgagggagttgagtacgatgtgaccgatttcaaacatcctggaggaaccgtgattttctacgctctctctaacactggagctgatgctactgaggctttcaaggagttccaccacagatctagaaaggctaggaaggctttggctgctttgccttctagacctgctaagaccgctaaagtggatgatgctgagatgctccaggatttcgctaagtggagaaaggagttggagagggacggattcttcaagccttctcctgctcatgttgcttacagattcgctgagttggctgctatgtacgctttgggaacctacttgatgtacgctagatacgttgtgtcctctgtgttggtttacgcttgcttcttcggagctagatgtggatgggttcaacacgagggaggacactcttctttgaccggaaacatctggtgggataagagaatccaagctttcactgctggattcggattggctggatctggagatatgtggaactccatgcacaacaagcaccacgctactcctcaaaaagtgaggcacgatatggatttggataccactcctgctgttgctttcttcaacaccgctgtggaggataatagacctaggggattctctaagtactggctcagattgcaagcttggaccttcattcctgtgacttctggattggtgttgctcttctggatgttcttcctccacccttctaaggctttgaagggaggaaagtacgaggagcttgtgtggatgttggctgctcacgtgattagaacctggaccattaaggctgttactggattcaccgctatgcaatcctacggactcttcttggctacttcttgggtttccggatgctacttgttcgctcacttctctacttctcacacccacttggatgttgttcctgctgatgagcacttgtcttgggttaggtacgctgtggatcacaccattgatatcgatccttctcagggatgggttaactggttgatgggatacttgaactgccaagtgattcaccacctcttcccttctatgcctcaattcagacaacctgaggtgtccagaagattcgttgctttcgctaagaagtggaacctcaactacaaggtgatgacttatgctggagcttggaaggctactttgggaaacctcgataatgtgggaaagcactactacgtgcacggacaacactctggaaagaccgcttgattaatgaaggccgcctcgaccgtaccccctgcagatagactatactatgttttagcctgcctgctggctagctactatgttatgttatgttgtaaaataaacacctgctaaggtatatctatctatattttagcatggctttctcaataaattgtctttccttatcgtttactatcttatacctaataatgaaataataatatcacatatgaggaacggggcaggtttaggcatatatatacgagtgtagggcggagtggggctacgtagcgtcacgtgacgttacctaagcctaggtagcctcagctgacgttacgtaacgctaggtaggctcagctgacacgggcaggacatagggactactacaagcatagtatgcttcagacaaagagctaggaaagaactcttgatggaggttaagagaaaaaagtgctagaggggcatagtaatcaaacttgtcaaaaccgtcatcatgatgagggatgacataatataaaaagttgactaaggtcttggtagtactctttgattagtattatatattggtgagaacatgagtcaagaggagacaagaaaccgaggaaccatagtttagcaacaagatggaagttgcaaagttgagctagccgctcgattagttacatctcctaagcagtactacaaggaatggtctctatactttcatgtttagcacatggtagtgcggattgacaagttagaaacagtgcttaggagacaaagagtcagtaaaggtattgaaagagtgaagttgatgctcgacaggtcaggagaagtccctccgccagatggtgactaccaaggggttggtatcagctgagacccaaataagattcttcggttgaaccagtggttcgaccgagactcttagggtgggatttcactgtaagatttgtgcattttgttgaatataaattgacaattttttttatttaattatagattatttagaatgaattacatatttagtttctaacaaggatagcaatggatgggtatgggtacaggttaaacatatctattacccacccatctagtcgtcgggttttacacgtacccacccgtttacataaaccagaccggaattttaaaccgtacccgtccgttagcgggtttcagatttacccgtttaatcgggtaaaacctgattactaaatatatattttttatttgataaacaaaacaaaaatgttaatattttcatattggatgcaattttaagaaacacatattcataaatttccatatttgtaggaaaataaaaagaaaaatatattcaagaacacaaatttcaccgacatgacttttattacagagttggaattagatctaacaattgaaaaattaaaattaagatagaatatgttgaggaacatgacatagtataatgctgggttacccgtcgggtaggtatcgaggcggatactactaaatccatcccactcgctatccgataatcactggtttcgggtatacccattcccgtcaacaggcctttttaaccggataatttcaacttatagtgaatgaattttgaataaatagttagaataccaaaatcctggattgcatttgcaatcaaattttgtgaaccgttaaattttgcatgtacttgggatagatataatagaaccgaattttcattagtttaatttataacttactttgttcaaagaaaaaaaatatctatccaatttacttataataaaaaataatctatccaagttacttattataatcaacttgtaaaaaggtaagaatacaaatgtggtagcgtacgtgtgattatatgtgacgaaatgttatatctaacaaaagtccaaattcccatggtaaaaaaaatcaaaatgcatggcaggctgtttgtaaccttggaataagatgttggccaattctggagccgccacgtacgcaagactcagggccacgttctcttcatgcaaggatagtagaacaccactccacccacctcctatattagacctttgcccaaccctccccaactttcccatcccatccacaaagaaaccgacatttttatcataaatctggtgcttaaacactctggtgagttctagtacttctgctatgatcgatctcattaccatttcttaaatttctctccctaaatattccgagttcttgatttttgataacttcaggttttctctttttgataaatctggtctttccattttttttttttgtggttaatttagtttcctatgttcttcgattgtattatgcatgatctgtgtttggattctgttagattatgtattggtgaatatgtatgtgtttttgcatgtctggttttggtcttaaaaatgttcaaatctgatgatttgattgaagcttttttagtgttggtttgattcttctcaaaactactgttaatttactatcatgttttccaactttgattcatgatgacacttttgttctgctttgttataaaattttggttggtttgattttgtaattatagtgtaattttgttaggaatgaacatgttttaatactctgttttcgatttgtcacacattcgaattattaatcgataatttaactgaaaattcatggttctagatcttgttgtcatcagattatttgtttcgataattcatcaaatatgtagtccttttgctgatttgcgactgtttcattttttctcaaaattgttttttgttaagtttatctaacagttatcgttgtcaaaagtctctttcattttgcaaaatcttctttttttttttgtttgtaactttgttttttaagctacacatttagtctgtaaaatagcatcgaggaacagttgtcttagtagacttgcatgttcttgtaacttctatttgtttcagtttgttgatgactgctttgattttgtaggtcaaaggcgcaccctaccatggatgcttataacgctgctatggataagattggagctgctatcatcgattggagtgatccagatggaaagttcagagctgatagggaggattggtggttgtgcgatttcagatccgctatcaccattgctctcatctacatcgctttcgtgatcttgggatctgctgtgatgcaatctctcccagctatggacccataccctatcaagttcctctacaacgtgtctcaaatcttcctctgcgcttacatgactgttgaggctggattcctcgcttataggaacggatacaccgttatgccatgcaaccacttcaacgtgaacgatccaccagttgctaacttgctctggctcttctacatctccaaagtgtgggatttctgggataccatcttcattgtgctcggaaagaagtggagacaactctctttcttgcacgtgtaccaccacaccaccatcttcctcttctactggttgaacgctaacgtgctctacgatggagatatcttcttgaccatcctcctcaacggattcattcacaccgtgatgtacacctactacttcatctgcatgcacaccaaggattctaagaccggaaagtctttgccaatctggtggaagtcatctttgaccgctttccaactcttgcaattcaccatcatgatgtcccaagctacctacttggttttccacggatgcgataaggtttccctcagaatcaccatcgtgtacttcgtgtacattctctcccttttcttcctcttcgctcagttcttcgtgcaatcctacatggctccaaagaagaagaagtccgcttgatgttaatgaaggccgcagatatcagatctggtcgacctagaggatccccggccgcaaagataataacaaaagcctactatataacgtacatgcaagtattgtatgatattaatgtttttacgtacgtgtaaacaaaaataattacgtttgtaacgtatggtgatgatgtggtgcactaggtgtaggccttgtattaataaaaagaagtttgttctatatagagtggtttagtacgacgatttatttactagtcggattggaatagagaaccgaattcttcaatccttgcttttgatcaagaattgaaaccgaatcaaatgtaaaagttgatatatttgaaaaacgtattgagcttatgaaaatgctaatactctcatctgtatggaaaagtgactttaaaaccgaacttaaaagtgacaaaaggggaatatcgcatcaaaccgaatgaaaccgatctacgtaggctcagctgagcttagctaagcctacctagcctcacgtgagattatgtaaggctaggtagcgtcacgtgacgttacctaacactagctagcgtcagctgagcttagctaaccctacgtagcctcacgtgagcttacctaacgctacgtagcctcacgtgactaaggatgacctacccattcttgagacaaatgttacattttagtatcagagtaaaatgtgtacctataactcaaattcgattgacatgtatccattcaacataaaattaaaccagcctgcacctgcatccacatttcaagtattttcaaaccgttcggctcctatccaccgggtgtaacaagacggattccgaatttggaagattttgactcaaattcccaatttatattgaccgtgactaaatcaactttaacttctataattctgattaagctcccaatttatattcccaacggcactacctccaaaatttatagactctcatccccttttaaaccaacttagtaaacgttttttttttaattttatgaagttaagtttttaccttgtttttaaaaagaatcgttcataagatgccatgccagaacattagctacacgttacacatagcatgcagccgcggagaattgtttttcttcgccacttgtcactcccttcaaacacctaagagcttctctctcacagcacacacatacaatcacatgcgtgcatgcattattacacgtgatcgccatgcaaatctcctttatagcctataaattaactcatcggcttcactctttactcaaaccaaaactcatcaatacaaacaagattaaaaacatttcacgatttggaatttgattcctgcgatcacaggtatgacaggttagattttgttttgtatagttgtatacatacttctttgtgatgttttgtttacttaatcgaatttttggagtgttttaaggtctctcgtttagaaatcgtggaaaatatcactgtgtgtgtgttcttatgattcacagtgtttatgggtttcatgttctttgttttatcattgaatgggaagaaatttcgttgggatacaaatttctcatgttcttactgatcgttattaggagtttggggaaaaaggaagagtttttttggttggttcgagtgattatgaggttatttctgtatttgatttatgagttaatggtcgttttaatgttgtagaccgccatggctattttgaaccctgaggctgattctgctgctaacctcgctactgattctgaggctaagcaaagacaattggctgaggctggatacactcacgttgagggtgctcctgctcctttgcctttggagttgcctcacttctctctcagagatctcagagctgctattcctaagcactgcttcgagagatctttcgtgacctccacctactacatgatcaagaacgtgttgacttgcgctgctttgttctacgctgctaccttcattgatagagctggagctgctgcttatgttttgtggcctgtgtactggttcttccagggatcttacttgactggagtgtgggttatcgctcacgagtgtggacaccaggcttattgctcttctgaggtggtgaacaacttgattggactcgtgttgcactctgctttgttggtgccttaccactcttggagaatctctcacagaaagcaccactccaacactggatcttgcgagaacgatgaggttttcgttcctgtgaccagatctgtgttggcttcttcttggaacgagaccttggaggattctcctctctaccaactctaccgtatcgtgtacatgttggttgttggatggatgcctggatacctcttcttcaacgctactggacctactaagtactggggaaagtctaggtctcacttcaacccttactccgctatctatgctgatagggagaggtggatgatcgtgctctccgatattttcttggtggctatgttggctgttttggctgctttggtgcacactttctccttcaacacgatggtgaagttctacgtggtgccttacttcattgtgaacgcttacttggtgttgattacctacctccaacacaccgatacctacatccctcacttcagagagggagagtggaattggttgagaggagctttgtgcactgtggatagatcatttggtccattcctcgattctgtggtgcatagaatcgtggatacccacgtttgccaccatatcttctccaagatgcctttctatcactgcgaggaggctaccaacgctattaagcctctcctcggaaagttctacttgaaggatactactcctgttcctgttgctctctggagatcttacacccactgcaagttcgttgaggatgatggaaaggtggtgttctacaagaacaagttatagttaatgaataattgattggttcgagtattatggcattgggaaaactgtttttcttgtaccatttgttgtgcttgtaatttactgtgttttttattcggttttcgctatcgaactgtgaaatggaaatggatggagaagagttaatgaatgatatggtccttttgttcattctcaaattaatattatttgttttttctcttatttgttgtgtgttgaatttgaaattataagagatatgcaaacattttgttttgagtaaaaatgtgtcaaatcgtggcctctaatgaccgaagttaatatgaggagtaaaacacttgtagttgtaccattatgcttattcactaggcaacaaatatattttcagacctagaaaagctgcaaatgttactgaatacaagtatgtcctcttgtgttttagacatttatgaactttcctttatgtaattttccagaatccttgtcagattctaatcattgctttataattatagttatactcatggatttgtagttgagtatgaaaatattttttaatgcattttatgacttgccaattgattgacaacatgcatcaatctagctagcctcagctgacgttacgtaacgctaggtagcgtcacgtgacgttagctaacgctaggtagcgtcagctgagcttacgtaagcgcacagatgaatactagctgttgttcacagttctagtgtctcctcattacgtgaattcaagctacgatcactatctcaactcctacataaacatcagaatgctacaaaactatgcacaaaaacaaaagctacatctaatacgtgaatcaattactctcatcacaagaaagaagatttcaatcaccgtcgagaaggaggattcagttaattgaatcaaagttccgatcaaactcgaagactggtgagcacgaggacgacgaagaagagtgtctcgaagatacaacaagcaagaaatctactgagtgacctcctgaagttattggcgcgattgagagaatcaatccgaattaatttcggggaaaaagataaattagatactaagcgatgggcttgggctgggctaagaaacaggtggcaattgggctggaggaccccgcgattcatagcttccgatagcccaaaaaaaaacggataacatatttatcgggtatttgaatttcagtgaaataagatattttctttttgttaggaaaattttagaaaataatggaaattaaatagcgattatgttacaagatacgatcagcatcgggcagtgcaaaatgctatagcttcccaagatttgatccttttgggttatctcctaatgacaattagtttaggattttgaaacttatattaatactattatccgacaacacttgtttcagcttcttattttaacattttttgtttttttctattcttcttcccatcagcattttctttttaaaaaattgaatactttaactttttaaaaatttcacaatgatcagatgatattatggaagatctcaagagttaaatgtatccatcttggggcattaaaaccggtgtacgggatgataaatacagactttatatcatatgatagctcagtaattcatatttatcacgttgctaaaaaaattataaggtactagtagtcaacaaaatcaattaaagagaaagaaagaaacgcatgtgaagagagtttacaactggaaaagtaaaataaaaattaacgcatgttgaatgctgacatgtcagtatgtccatgaatccacgtatcaagcgccattcatcgatcgtcttcctctttctaaatgaaaacaacttcacacatcacaacaaacaatacacacaagaccccctctctctcgttgtctctctgccagcgaccaaatcgaagcttgagaagaacaagaaggggtcaaaccatggcttctacatctgctgctcaagacgctgctccttacgagttcccttctctcactgagatcaagagggctcttccttctgagtgtttcgaggcttctgttcctctttctctctactacaccgctagatctcttgctcttgctggatctctcgctgttgctctctcttacgctagagctttgcctcttgttcaggctaacgctcttcttgatgctactctctgcactggatacgttcttctccagggaatcgttttctggggattcttcaccgttggtcacgattgtggacacggagctttctctagatctcacgtgctcaacttctctgttggaaccctcatgcactctatcatccttacccctttcgagtcttggaagctctctcacagacaccaccacaagaacaccggaaacatcgataaggacgagatcttctaccctcaaagagaggctgattctcaccctgtttctagacaccttgtgatgtctcttggatctgcttggttcgcttaccttttcgctggattccctcctagaaccatgaaccacttcaacccttgggaggctatgtatgttagaagagtggctgctgtgatcatctctctcggagttcttttcgctttcgctggactctactcttacctcaccttcgttcttggattcaccactatggctatctactacttcggacctctcttcatcttcgctaccatgcttgttgttaccactttcctccaccacaacgatgaggagacaccttggtacgctgattctgagtggacttacgtgaagggaaacctctcttctgtggacagatcttacggtgctctcatcgacaaccttagccacaacatcggaactcaccagatccaccacctcttccctatcatccctcactacaagctcaacgatgctactgctgctttcgctaaggctttccctgagcttgttaggaaaaacgctgctcctatcatcccaactttcttcaggatggctgctatgtacgctaagtacggagttgttgacactgatgctaagaccttcactctcaaggaggctaaggctgctgctaagactaagtcatcttgatgattaatgaataattgattgtacatactatattttttgtttaccttgtgttagtttaatgttcagtgtcctctctttattgtggcacgtctctttgttgtatgttgtgtctatacaaagttgaaataatggaaagaaaaggaagagtgtaatttgttttgttttaagtgtttataaatatatatatataggtcatttagatagttctaggtttctataaaactctctctctggaagtagaatctgtttttgagaggatccagttgcctactaatctcccccaaaacccttcaagcttaaccttcctcttcacaacaacagaggaaacacatctcttgagctctgagttctcttctttgagcatgtctatcgctaaactcatctgccttatagcttccctcttctcttcatctctctctctcaccatttcgctgtaaaacttattctcctccctcagcctctctatctcttccttcagcatctcacaattcccaccataatcgactgaggatgattcaccgtcatcaacttcagactcagcgttgtagtcgtcatgagtctcacaagccttggaccaagaagactcatcatcgcaagttgatgatttatcatgatgcttctctgagccgtgtttgctacgtagcgtcacgtgacgttacctaagcctaggtagcctcagctgacgttacgtaacgctaggtaggctcagctgactgcagcaaatttacacattgccactaaacgtctaaacccttgtaatttgtttttgttttactatgtgtgttatgtatttgatttgcgataaatttttatatttggtactaaatttataacaccttttatgctaacgtttgccaacacttagcaatttgcaagttgattaattgattctaaattatttttgtcttctaaatacatatactaatcaactggaaatgtaaatatttgctaatatttctactataggagaattaaagtgagtgaatatggtaccacaaggtttggagatttaattgttgcaatgctgcatggatggcatatacaccaaacattcaataattcttgaggataataatggtaccacacaagatttgaggtgcatgaacgtcacgtggacaaaaggtttagtaatttttcaagacaacaatgttaccacacacaagttttgaggtgcatgcatggatgccctgtggaaagtttaaaaatattttggaaatgatttgcatggaagccatgtgtaaaaccatgacatccacttggaggatgcaataatgaagaaaactacaaatttacatgcaactagttatgcatgtagtctatataatgaggattttgcaatactttcattcatacacactcactaagttttacacgattataatttcttcatagccagtactgtttaagcttcactgtctctgaatcggcaaaggtaaacgtatcaattattctacaaacccttttatttttcttttgaattaccgtcttcattggttatatgataacttgataagtaaagcttcaataattgaatttgatctgtgtttttttggccttaatactaaatccttacataagctttgttgcttctcctcttgtgagttgagtgttaagttgtaataatggttcactttcagctttagaagaaacgcgccttccatggctacaaaggaggcttacgttttcccaactctcaccgagatcaagagatctctcccaaaggattgcttcgaggcttctgtgcctttgtctctctactacactgtgagatgcttggttattgctgtggctttgaccttcggattgaactacgctagagctttgccagaggttgagtctttctgggctttggatgctgctttgtgcactggatatatcctcctccagggaattgtgttctggggattcttcactgttggacacgatgctggacacggagctttctctagataccacctcttgaacttcgttgtgggaaccttcatgcactctctcatcttgaccccattcgagtcttggaagttgacccacagacaccaccacaagaacaccggaaacatcgatagagatgaggtgttctacccacagagaaaggctgatgatcacccattgtccaggaacttgatcttggctttgggagctgcttggcttgcttatttggtggagggattcccaccaagaaaggtgaaccacttcaacccattcgagccactttttgtgagacaagtgtccgctgtggttatctctttgctcgctcacttcttcgttgctggactctctatctacttgtctctccagttgggacttaagaccatggctatctactactacggaccagttttcgtgttcggatctatgttggtgattaccaccttcttgcaccacaacgatgaggagactccatggtatgctgattctgagtggacttacgtgaagggaaacttgtcctctgtggatagatcttacggtgctctcatcgataacctctcccacaacatcggaactcaccagatccaccacctcttcccaattatcccacactacaagctcaagaaggctactgctgctttccaccaagctttcccagagcttgtgagaaagtccgatgagccaatcatcaaggctttcttcagagtgggaaggttgtatgctaactacggagtggttgatcaagaggctaagctcttcactttgaaggaggctaaggctgctactgaagctgctgctaagaccaagtctacctgattaatgaatcgacaagctcgagtttctccataataatgtgtgagtagttcccagataagggaattagggttcctatagggtttcgctcatgtgttgagcatataagaaacccttagtatgtatttgtatttgtaaaatacttctatcaataaaatttctaattcctaaaaccaaaatccagtactaaaatccagatcccccgaattaattcggcgttaattcagctacgtaggctcagctgagcttacctaaggctacgtaggctcacgtgacgttacgtaaggctacgtagcgtcacgtgagcttacctaactctagctagcctcacgtgaccttagctaacactaggtagcgtcagcacagatgaatactagctgttgttcacagttctagtgtctcctcattacgtgaattcaagctacgatcactatctcaactcctacataaacatcagaatgctacaaaactatgcacaaaaacaaaagctacatctaatacgtgaatcaattactctcatcacaagaaagaagatttcaatcaccgtcgagaaggaggattcagttaattgaatcaaagttccgatcaaactcgaagactggtgagcacgaggacgacgaagaagagtgtctcgaagatacaacaagcaagaaatctactgagtgacctcctgaagttattggcgcgattgagagaatcaatccgaattaatttcggggaaaaagataaattagatactaagcgatgggcttgggctgggctaagaaacaggtggcaattgggctggaggaccccgcgattcatagcttccgatagcccaaaaaaaaacggataacatatttatcgggtatttgaatttcagtgaaataagatattttctttttgttaggaaaattttagaaaataatggaaattaaatagcgattatgttacaagatacgatcagcatcgggcagtgcaaaatgctatagcttcccaagatttgatccttttgggttatctcctaatgacaattagtttaggattttgaaacttatattaatactattatccgacaacacttgtttcagcttcttattttaacattttttgtttttttctattcttcttcccatcagcattttctttttaaaaaattgaatactttaactttttaaaaatttcacaatgatcagatgatattatggaagatctcaagagttaaatgtatccatcttggggcattaaaaccggtgtacgggatgataaatacagactttatatcatatgatagctcagtaattcatatttatcacgttgctaaaaaaattataaggtactagtagtcaacaaaatcaattaaagagaaagaaagaaacgcatgtgaagagagtttacaactggaaaagtaaaataaaaattaacgcatgttgaatgctgacatgtcagtatgtccatgaatccacgtatcaagcgccattcatcgatcgtcttcctctttctaaatgaaaacaacttcacacatcacaacaaacaatacacacaagaccccctctctctcgttgtctctctgccagcgaccaaatcgaagcttgagaagaacaagaaggggtcaaaccatgggaaaaggatctgagggaagatctgctgctagagagatgactgctgaggctaacggagataagagaaagaccatcctcattgagggagtgttgtacgatgctaccaacttcaaacacccaggaggttccattattaacttcctcaccgagggagaagctggagttgatgctacccaagcttacagagagttccatcagagatccggaaaggctgataagtacctcaagtccctcccaaagttggatgcttctaaggtggagtctaggttctctgctaaggagcaggctagaagggacgctatgaccagggattacgctgctttcagagaggagttggttgctgagggatacttcgatccatctatcccacacatgatctacagagtggtggagattgtggctttgttcgctttgtctttctggttgatgtctaaggcttctccaacctctttggttttgggagtggtgatgaacggaatcgctcaaggaagatgcggatgggttatgcacgagatgggacacggatctttcactggagttatctggctcgatgataggatgtgcgagttcttctacggagttggatgtggaatgtctggacactactggaagaaccagcactctaagcaccacgctgctccaaacagattggagcacgatgtggatttgaacaccttgccactcgttgctttcaacgagagagttgtgaggaaggttaagccaggatctttgttggctttgtggctcagagttcaggcttatttgttcgctccagtgtcttgcttgttgatcggattgggatggaccttgtacttgcacccaagatatatgctcaggaccaagagacacatggagtttgtgtggatcttcgctagatatatcggatggttctccttgatgggagctttgggatattctcctggaacttctgtgggaatgtacctctgctctttcggacttggatgcatctacatcttcctccaattcgctgtgtctcacacccacttgccagttaccaacccagaggatcaattgcactggcttgagtacgctgctgatcacaccgtgaacatctctaccaagtcttggttggttacctggtggatgtctaacctcaacttccaaatcgagcaccacttgttcccaaccgctccacaattcaggttcaaggagatctctccaagagttgaggctctcttcaagagacacaacctcccttactacgatttgccatacacctctgctgtttctactaccttcgctaacctctactctgttggacactctgttggagctgataccaagaagcaggattgatgattaatgaataattgattgtacatactatattttttgtttaccttgtgttagtttaatgttcagtgtcctctctttattgtggcacgtctctttgttgtatgttgtgtctatacaaagttgaaataatggaaagaaaaggaagagtgtaatttgttttgttttaagtgtttataaatatatatatataggtcatttagatagttctaggtttctataaaactctctctctggaagtagaatctgtttttgagaggatccagttgcctactaatctcccccaaaacccttcaagcttaaccttcctcttcacaacaacagaggaaacacatctcttgagctctgagttctcttctttgagcatgtctatcgctaaactcatctgccttatagcttccctcttctcttcatctctctctctcaccatttcgctgtaaaacttattctcctccctcagcctctctatctcttccttcagcatctcacaattcccaccataatcgactgaggatgattcaccgtcatcaacttcagactcagcgttgtagtcgtcatgagtctcacaagccttggaccaagaagactcatcatcgcaagttgatgatttatcatgatgcttctctgagccgtgtttgctacctagagtcagctgagcttagctaacgctagctagtgtcagctgacgttacgtaaggctaactagcgtcacgtgaccttacgtaacgctacgtaggctcagctgagcttagctaaccctagctagtgtcacgtgagcttacgctactatagaaaatgtgttatatcgacatgaccagacaaaggggcaacagttaacaaaacaattaattctttcatttgagattaaggaaggtaaggtactaaaaagattaaaaaaaatgagcttatctctttgtttctgtaataataatataagtgtgataaacttttaatataataattgtaattaggttttctacagatgagcaccactcagagacaagataagaagaaaacaattttgttaaacatgattatagaaacttttagttaagtcttgaagtatcaatataacaaaaaaaagtacacacgactatgacaataaacccactaccgtcaggttatcatttcgatgaaatgttttgatatcattaaatataacagtcacaaaaaatcatctaattataacaatataacttatacatatatttaactaaaaacttagagtttttgtaatgattctaattgatgattagagtttatagaaatacaattaaataaaaaatataattttaaaaaaacatagtaaagtcaatgagatcctctctgacctcagtgatcatttagtcatgtatgtacaacaatcattgttcatcacatgactgtaaaataaataaggataaacttgggaatatatataatatattgtattaaataaaaaagggaaatacaaatatcaattttagattcccgagttgacacaactcaccatgcacgctgccacctcagctcccagctctcgtcacatgtctcatgtcagttaggtctttggtttttagtctttgacacaactcgccatgcatgttgccacgtgagctcgttcctcttcccatgatctcaccactgggcatgcatgctgccacctcagctggcacctcttctctatatgtccctagaggccatgcacagtgccacctcagcactcctctcagaacccatacgtacctgccaatcggcttctctccataaatatctatttaaattataactaattatttcatatacttaattgatgacgtggatgcattgccatcgttgtttaataattgttaattacgacatgataaataaaatgaaagtaaaaagtacgaaagattttccatttgttgttgtataaatagagaagtgagtgatgcataatgcatgaatgcatgaccgcgccaccatgactgttggatacgacgaggagatcccattcgagcaagttagggctcataacaagccagacgacgcttggtgtgctattcacggacacgtgtacgacgttaccaagttcgcttcagttcacccaggaggagatattatcttgctcgctgctggaaaggaagctactgtcctctacgagacctaccatgttagaggagtgtctgacgctgtgctcagaaagtacagaataggaaagttgccagacggacaaggaggagctaacgagaaggagaagagaaccttgtctggattgtcctctgcttcttactacacctggaactccgatttctacagagtgatgagggagagagttgtggctagattgaaggagagaggaaaggctagaagaggaggatacgaactctggatcaaggctttcttgctccttgttggattctggtcctctctttactggatgtgcaccctcgatccatctttcggagctatcttggctgctatgtctttgggagtgttcgctgcttttgttggaacctgcatccaacacgatggaaaccacggagctttcgctcaatctagatgggttaacaaggtggcaggatggactttggatatgatcggagcttctggaatgacttgggagttccaacacgtgttgggacaccacccatacactaacttgatcgaggaggagaacggattgcaaaaggtgtccggaaagaagatggataccaagttggctgatcaagagtctgatccagatgtgttctccacctacccaatgatgagattgcacccttggcaccagaagaggtggtatcacaggttccagcacatctacggacctttcatcttcggattcatgaccatcaacaaggtggtgactcaagatgttggagtggtgttgagaaagagactcttccaaatcgatgctgagtgcagatatgcttccccaatgtacgttgctaggttctggattatgaaggctttgaccgtgttgtatatggttgctttgccttgttatatgcaaggaccttggcacggattgaaactcttcgctatcgctcacttcacttgcggagaggttttggctaccatgttcatcgtgaaccacattatcgagggagtgtcttacgcttctaaggatgctgttaagggaactatggctccaccaaagactatgcacggagtgaccccaatgaacaacactagaaaggaggttgaggctgaggcttctaagtctggagctgtggttaagtctgtgccattggatgattgggctgctgttcagtgccaaacctctgtgaactggtctgttggatcttggttttggaaccacttctctggaggactcaaccaccaaatcgagcaccacctcttcccaggattgtctcacgagacctactaccacatccaagacgtggttcaatctacctgtgctgagtacggagttccataccaacacgagccatctttgtggactgcttactggaagatgctcgaacaccttagacaattgggaaacgaggagactcacgagtcatggcagagagctgcttgattaatgaactaagactcccaaaaccaccttccctgtgacagttaaaccctgcttatacctttcctcctaataatgttcatctgtcacacaaactaaaataaataaaatgggagcaataaataaaatgggagctcatatatttacaccatttacactgtctattattcaccatgccaattattacttcataattttaaaattatgtcatttttaaaaattgcttaatgatggaaaggattattataagttaaaagtataacatagataaactaaccacaaaacaaatcaatataaactaacttactctcccatctaatttttatttaaatttctttacacttctcttccatttctatttctacaacattatttaacatttttattgtatttttcttactttctaactctattcatttcaaaaatcaatatatgtttatcaccacctctctaaaaaaaactttacaatcattggtccagaaaagttaaatcacgagatggtcattttagcattaaaacaacgattcttgtatcactatttttcagcatgtagtccattctcttcaaacaaagacagcggctatataatcgttgtgttatattcagtctaaaacaactagctagcctcagctgacgttacgtaacgctaggtagcgtcacgtgacgttagctaacgctaggtagcgtcagctgagcttacgtaagcgccacgggcaggacatagggactactacaagcatagtatgcttcagacaaagagctaggaaagaactcttgatggaggttaagagaaaaaagtgctagaggggcatagtaatcaaacttgtcaaaaccgtcatcatgatgagggatgacataatataaaaagttgactaaggtcttggtagtactctttgattagtattatatattggtgagaacatgagtcaagaggagacaagaaaccgaggaaccatagtttagcaacaagatggaagttgcaaagttgagctagccgctcgattagttacatctcctaagcagtactacaaggaatggtctctatactttcatgtttagcacatggtagtgcggattgacaagttagaaacagtgcttaggagacaaagagtcagtaaaggtattgaaagagtgaagttgatgctcgacaggtcaggagaagtccctccgccagatggtgactaccaaggggttggtatcagctgagacccaaataagattcttcggttgaaccagtggttcgaccgagactcttagggtgggatttcactgtaagatttgtgcattttgttgaatataaattgacaattttttttatttaattatagattatttagaatgaattacatatttagtttctaacaaggatagcaatggatgggtatgggtacaggttaaacatatctattacccacccatctagtcgtcgggttttacacgtacccacccgtttacataaaccagaccggaattttaaaccgtacccgtccgttagcgggtttcagatttacccgtttaatcgggtaaaacctgattactaaatatatattttttatttgataaacaaaacaaaaatgttaatattttcatattggatgcaattttaagaaacacatattcataaatttccatatttgtaggaaaataaaaagaaaaatatattcaagaacacaaatttcaccgacatgacttttattacagagttggaattagatctaacaattgaaaaattaaaattaagatagaatatgttgaggaacatgacatagtataatgctgggttacccgtcgggtaggtatcgaggcggatactactaaatccatcccactcgctatccgataatcactggtttcgggtatacccattcccgtcaacaggcctttttaaccggataatttcaacttatagtgaatgaattttgaataaatagttagaataccaaaatcctggattgcatttgcaatcaaattttgtgaaccgttaaattttgcatgtacttgggatagatataatagaaccgaattttcattagtttaatttataacttactttgttcaaagaaaaaaaatatctatccaatttacttataataaaaaataatctatccaagttacttattataatcaacttgtaaaaaggtaagaatacaaatgtggtagcgtacgtgtgattatatgtgacgaaatgttatatctaacaaaagtccaaattcccatggtaaaaaaaatcaaaatgcatggcaggctgtttgtaaccttggaataagatgttggccaattctggagccgccacgtacgcaagactcagggccacgttctcttcatgcaaggatagtagaacaccactccacccacctcctatattagacctttgcccaaccctccccaactttcccatcccatccacaaagaaaccgacatttttatcataaatcagggtttcgtttttgtttcatcgataaactcaaaggtgatgattttagggtcttgtgagtgtgcttttttgtttgattctactgtagggtttatgttctttagctcataggttttgtgtatttcttagaaatgtggcttctttaatctctgggtttgtgactttttgtgtggtttctgtgtttttcatatcaaaaacctattttttccgagtttttttttacaaattcttactctcaagcttgaatacttcacatgcagtgttcttttgtagattttagagttaatgtgttaaaaagtttggatttttcttgcttatagagcttcttcactttgattttgtgggtttttttgttttaaaggtgagatttttgatgaggtttttgcttcaaagatgtcacctttctgggtttgtcttttgaataaagctatgaactgtcacatggctgacgcaattttgttactatgtcatgaaagctgacgtttttccgtgttatacatgtttgcttacacttgcatgcgtcaaaaaaattggggctttttagttttagtcaaagattttacttctcttttgggatttatgaaggaaagttgcaaactttctcaaattttaccatttttgctttgatgtttgtttagattgcgacagaacaaactcatatatgttgaaatttttgcttggttttgtataggattgtgtcttttgcttataaatgttgaaatctgaactttttttttgtttggtttctttgagcaggagataaggcgcaccaccatggcttctacatctgctgctcaagacgctgctccttacgagttcccttctctcactgagatcaagagggctcttccttctgagtgtttcgaggcttctgttcctctttctctctactacaccgctagatctcttgctcttgctggatctctcgctgttgctctctcttacgctagagctttgcctcttgttcaggctaacgctcttcttgatgctactctctgcactggatacgttcttctccagggaatcgttttctggggattcttcaccgttggtcacgattgtggacacggagctttctctagatctcacgtgctcaacttctctgttggaaccctcatgcactctatcatccttacccctttcgagtcttggaagctctctcacagacaccaccacaagaacaccggaaacatcgataaggacgagatcttctaccctcaaagagaggctgattctcaccctgtttctagacaccttgtgatgtctcttggatctgcttggttcgcttaccttttcgctggattccctcctagaaccatgaaccacttcaacccttgggaggctatgtatgttagaagagtggctgctgtgatcatctctctcggagttcttttcgctttcgctggactctactcttacctcaccttcgttcttggattcaccactatggctatctactacttcggacctctcttcatcttcgctaccatgcttgttgttaccactttcctccaccacaacgatgaggagacaccttggtacgctgattctgagtggacttacgtgaagggaaacctctcttctgtggacagatcttacggtgctctcatcgacaaccttagccacaacatcggaactcaccagatccaccacctcttccctatcatccctcactacaagctcaacgatgctactgctgctttcgctaaggctttccctgagcttgttaggaaaaacgctgctcctatcatcccaactttcttcaggatggctgctatgtacgctaagtacggagttgttgacactgatgctaagaccttcactctcaaggaggctaaggctgctgctaagactaagtcatcttgatgattaatgaaggccgcagatatcagatctggtcgacctagaggatccccggccgcaaagataataacaaaagcctactatataacgtacatgcaagtattgtatgatattaatgtttttacgtacgtgtaaacaaaaataattacgtttgtaacgtatggtgatgatgtggtgcactaggtgtaggccttgtattaataaaaagaagtttgttctatatagagtggtttagtacgacgatttatttactagtcggattggaatagagaaccgaattcttcaatccttgcttttgatcaagaattgaaaccgaatcaaatgtaaaagttgatatatttgaaaaacgtattgagcttatgaaaatgctaatactctcatctgtatggaaaagtgactttaaaaccgaacttaaaagtgacaaaaggggaatatcgcatcaaaccgaatgaaaccgatctacgtaggctcagctgagcttacctaaggctacgtaggctcacgtgacgttacgtaaggctacgtagcgtcacgtgagcttacctaactctagctagcctcacgtgaccttagctaacactaggtagcgtcagcttagcagatatttggtgtctaaatgtttattttgtgatatgttcatgtttgaaatggtggtttcgaaaccagggacaacgttgggatctgatagggtgtcaaagagtattatggattgggacaatttcggtcatgagttgcaaattcaagtatatcgttcgattatgaaaattttcgaagaatatcccatttgagagagtctttacctcattaatgtttttagattatgaaattttatcatagttcatcgtagtctttttggtgtaaaggctgtaaaaagaaattgttcacttttgttttcgtttatgtgaaggctgtaaaagattgtaaaagactattttggtgttttggataaaatgatagtttttatagattcttttgcttttagaagaaatacatttgaaattttttccatgttgagtataaaataccgaaatcgattgaagatcatagaaatattttaactgaaaacaaatttataactgattcaattctctccatttttatacctatttaaccgtaatcgattctaatagatgatcgattttttatataatcctaattaaccaacggcatgtattggataattaaccgatcaactctcacccctaatagaatcagtattttccttcgacgttaattgatcctacactatgtaggtcatatccatcgttttaatttttggccaccattcaattctgtcttgcctttagggatgtgaatatgaacggccaaggtaagagaataaaaataatccaaattaaagcaagagaggccaagtaagataatccaaatgtacacttgtcattgccaaaattagtaaaatactcggcatattgtattcccacacattattaaaataccgtatatgtattggctgcatttgcatgaataatactacgtgtaagcccaaaagaacccacgtgtagcccatgcaaagttaacactcacgaccccattcctcagtctccactatataaacccaccatccccaatctcaccaaacccaccacacaactcacaactcactctcacaccttaaagaaccaatcaccaccaaaaaaagttctttgctttcgaagttgccgcaacctaaacaggtttttccttcttctttcttcttattaactacgaccttgtcctttgcctatgtaaaattactaggttttcatcagttacactgattaagttcgttatagtggaagataaaatgccctcaaagcattttgcaggatatctttgatttttcaaagatatggaactgtagagtttgatagtgttcttgaatgtggttgcatgaagtttttttggtctgcatgttattttttcctcgaaatatgttttgagtccaacaagtgattcacttgggattcagaaagttgttttctcaatatgtaacagtttttttctatggagaaaaatcatagggaccgttggttttggcttctttaattttgagctcagattaaacccattttacccggtgttcttggcagaattgaaaacagtacgtagtaccgcgcctaccatgccacctagtgctgctagtgaaggtggtgttgctgaacttagagctgctgaagttgctagctacactagaaaggctgttgacgaaagacctgacctcactatagttggtgacgctgtttacgacgctaaggcttttagggacgagcaccctggtggtgctcacttcgttagccttttcggaggtagggacgctactgaggcttttatggaatatcaccgtagagcttggcctaaggctaggatgtctaagttcttcgttggttcacttgacgctagcgagaagcctactcaagctgattcagcttaccttagactttgcgctgaggttaacgctcttttgcctaagggtagcggaggattcgctcctcctagctactggcttaaggctgctgctcttgttgttgctgctgttagtatagagggttatatgctccttaggggtaagacccttttgcttagcgttttccttggactcgtgttcgcttggataggacttaatattcagcacgacgctaatcacggtgctcttagtagacactcagtgattaactactgcctcggttacgctcaggattggataggtggtaatatggtgctttggcttcaagagcacgttgtgatgcaccacctccacactaacgacgttgacgctgatcctgatcaaaaggctcacggtgttcttagacttaagcctactgacggttggatgccttggcacgcacttcaacaactctatatccttcctggtgaggctatgtacgcttttaagcttcttttcttggacgcccttgagcttcttgcttggaggtgggagggtgagaagattagccctcttgctagagctttgttcgctcctgctgttgcttgtaagcttggattctgggctagattcgttgctctccctctctggcttcaacctactgttcacactgctttgtgtatctgtgctactgtgtgtactggtagcttctacctcgccttcttcttctttatctctcacaacttcgacggtgttggtagcgttggacctaagggatcacttcctagatcagctactttcgttcaacgtcaggttgagactagctctaacgttggtggttactggcttggagttcttaacggtggacttaactttcagatagagcaccacttgttccctaggcttcaccactcttactacgctcaaatagctcctgtggttaggactcacatagagaagctcggttttaagtaccgtcacttccctaccgttggatctaaccttagctcaatgcttcagcatatgggtaagatgggaactagacctggtgctgagaagggtggtaaggctgagtagtgattaatgaataattgattgctgctttaatgagatatgcgagacgcctatgatcgcatgatatttgctttcaattctgttgtgcacgttgtaaaaaacctgagcatgtgtagctcagatccttaccgccggtttcggttcattctaatgaatatatcacccgttactatcgtatttttatgaataatattctccgttcaatttactgattgtctacgtagcgtcacctgacgttacgtaaggctacctaggctcacgtgacgttacgtaacgctacgtagcgtcaggtgaggttagctaacgctagctagcctcacctgacgttaggtaaggctacgtagcgtcacctgagattagctaagcctacctagactcacgtgaccttaggtaacgctacgtagcgtcaaagctttacaacgctacacaaaacttataaccgtaatcaccattcattaacttaactactatcacatgcattcatgaattgaaacgagaaggatgtaaatagttgggaagttatctccacgttgaagagatcgttagcgagagctgaaagaccgagggaggagacgccgtcaacacggacagagtcgtcgaccctcacatgaagtaggaggaatctccgtgaggagccagagagacgtctttggtcttcggtttcgatccttgatctgacggagaagacgagagaagtgcgactggactccgtgaggaccaacagagtcgtcctcggtttcgatcgtcggtattggtggagaaggcggaggaatctccgtgacgagccagagagatgtcgtcggtcttcggtttcgatccttgatctgacggagaagacgagagaagtgcgacgagactccgtgaggaccaacagagttgtcctcggtttcgatcgtcggtttcggcggagaaggcggaggaatctccgtgaggagccagagagacgtcgttggtcttcggtttcgatccttgatctgttggagaagacgagacaagtgggacgagactcaacgacggagtcagagacgtcgtcggtcttcggtttcggccgagaaggcggagtcggtcttcggtttcggccgagaaggcggaggagacgtcttcgatttgggtctctcctcttgacgaagaaaacaaagaacacgagaaataatgagaaagagaacaaaagaaaaaaaaataaaaataaaaataaaatttggtcctcttatgtggtgacacgtggtttgaaacccaccaaataatcgatcacaaaaaacctaagttaaggatcggtaataacctttctaattaattttgatttatattaaatcactctttttatttataaaccccactaaattatgcgatattgattgtctaagtacaaaaattctctcgaattcaatacacatgtttcatatatttagccctgttcatttaatattactagcgcatttttaatttaaaattttgtaaacttttttggtcaaagaacatttttttaattagagacagaaatctagactctttatttggaataatagtaataaagatatattaggcaatgagtttatgatgttatgtttatatagtttatttcattttaaattgaaaagcattatttttatcgaaatgaatctagtatacaatcaatatttatgttttttcatcagatactttcctattttttggcacctttcatcggactactgatttatttcaatgtgtatgcatgcatgagcatgagtatacacatgtcttttaaaatgcatgtaaagcgtaacggaccacaaaagaggatccatacaaatacatctcatcgcttcctctactattctccgacacacacactgagcatggtgcttaaacactctggtgagttctagtacttctgctatgatcgatctcattaccatttcttaaatttctctccctaaatattccgagttcttgatttttgataacttcaggttttctctttttgataaatctggtctttccatttttttttttttgtggttaatttagtttcctatgttcttcgattgtattatgcatgatctgtgtttggattctgttagattatgtattggtgaatatgtatgtgtttttgcatgtctggttttggtcttaaaaatgttcaaatctgatgatttgattgaagcttttttagtgttggtttgattcttctcaaaactactgttaatttactatcatgttttccaactttgattcatgatgacacttttgttctgctttgttataaaattttggttggtttgattttgtaattatagtgtaattttgttaggaatgaacatgttttaatactctgttttcgatttgtcacacattcgaattattaatcgataatttaactgaaaattcatggttctagatcttgttgtcatcagattatttgtttcgataattcatcaaatatgtagtccttttgctgatttgcgactgtttcattttttctcaaaattgttttttgttaagtttatctaacagttatcgttgtcaaaagtctctttcattttgcaaaatcttctttttttttttgtttgtaactttgttttttaagctacacatttagtctgtaaaatagcatcgaggaacagttgtcttagtagacttgcatgttcttgtaacttctatttgtttcagtttgttgatgactgctttgattttgtaggtcaaaccgcgccatgtctgctagcggagctttgttgcctgctatagctttcgctgcttacgcttacgctacctacgcttatgctttcgagtggagccacgctaacggaatcgataacgtggatgctagagagtggattggagctttgtctttgagactccctgcaattgcaaccacaatgtacctcttgttctgccttgtgggacctagattgatggctaagagggaggcttttgatcctaagggatttatgctcgcttacaacgcttaccaaaccgctttcaacgttgtggtgctcggaatgttcgctagagagatctctggattgggacaacctgtttggggatctactatgccttggagcgataggaagtccttcaagattttgttgggagtgtggctccactacaacaataagtacctcgagttgttggatactgtgttcatggtggctaggaaaaagaccaagcagctctctttcttgcacgtgtaccaccacgctttgttgatttgggcttggtggcttgtttgtcacctcatggctaccaacgattgcatcgatgcttatttcggagctgcttgcaactctttcatccacatcgtgatgtactcctactacctcatgtctgctttgggaattaggtgcccttggaagagatatatcacccaggctcagatgttgcaattcgtgatcgtgttcgctcacgctgttttcgtgctcagacaaaagcactgccctgttactttgccttgggcacaaatgttcgtgatgacaaatatgttggtgctcttcggaaacttctacctcaaggcttactctaacaagtctaggggagatggagcttcttctgttaagcctgctgagactactagagcaccttctgtgagaagaaccaggtcaaggaagatcgattgatagttaatgaactaagtttgatgtatctgagtgccaacgtttactttgtctttcctttcttttattggttatgattagatgtttactatgttctctctttttcgttataaataaagaagttcaattcttctatagtttcaaacgcgattttaagcgtttctatttaggtttacatgatttcttttacaaaatcatctttaaaatacagtatatttttagttttcataaaatatttaaagaaatgaaagtttataaacattcactcctattctctaattaaggatttgtaaaacaaaaattttgtaagcatatcgatttatgcgttttgtcttaattagctcactaaataataaataatagcttatgttgtgggactgtttaattacctaacttagaactaaaatcaactctttgtgctagctagcctcagctgacgttacgtaacgctaggtagcgtcacgtgacgttagctaacgctaggtagcgtcagctgagcttacgtaagcgcttaattaaagtactgatatcggtaccaaatcgaatccaaaaattacggatatgaatataggcatatccgtatccgaattatccgtttgacagctagcaacgattgtacaattgcttctttaaaaaaggaagaaagaaagaaagaaaagaatcaacatcagcgttaacaaacggccccgttacggcccaaacggtcatatagagtaacggcgttaagcgttgaaagactcctatcgaaatacgtaaccgcaaacgtgtcatagtcagatcccctcttccttcaccgcctcaaacacaaaaataatcttctacagcctatatatacaacccccccttctatctctcctttctcacaattcatcatctttctttctctacccccaattttaagaaatcctctcttctcctcttcattttcaaggtaaatctctctctctctctctctctctgttattccttgttttaattaggtatgtattattgctagtttgttaatctgcttatcttatgtatgccttatgtgaatatctttatcttgttcatctcatccgtttagaagctataaatttgttgatttgactgtgtatctacacgtggttatgtttatatctaatcagatatgaatttcttcatattgttgcgtttgtgtgtaccaatccgaaatcgttgatttttttcatttaatcgtgtagctaattgtacgtatacatatggatctacgtatcaattgttcatctgtttgtgtttgtatgtatacagatctgaaaacatcacttctctcatctgattgtgttgttacatacatagatatagatctgttatatcattttttttattaattgtgtatatatatatgtgcatagatctggattacatgattgtgattatttacatgattttgttatttacgtatgtatatatgtagatctggactttttggagttgttgacttgattgtatttgtgtgtgtatatgtgtgttctgatcttgatatgttatgtatgtgcagctgaaccatggcggcggcaacaacaacaacaacaacatcttcttcgatctccttctccaccaaaccatctccttcctcctccaaatcaccattaccaatctccagattctccctcccattctccctaaaccccaacaaatcatcctcctcctcccgccgccgcggtatcaaatccagctctccctcctccatctccgccgtgctcaacacaaccaccaatgtcacaaccactccctctccaaccaaacctaccaaacccgaaacattcatctcccgattcgctccagatcaaccccgcaaaggcgctgatatcctcgtcgaggctttagaacgtcaaggcgtagaaaccgtattcgcttaccctggaggtacatcaatggagattcaccaagccttaacccgctcttcctcaatccgtaacgtccttcctcgtcacgaacaaggaggtgtattcgcagcagaaggatacgctcgatcctcaggtaaaccaggtatctgtatagccacttcaggtcccggagctacaaatctcgttagcggattagccgatgcgttgttagatagtgttcctcttgtagcaatcacaggacaagtccctcgtcgtatgattggtacagatgcgtttcaagagactccgattgttgaggtaacgcgttcgattacgaagcataactatcttgtgatggatgttgaagatatcccaaggattattgaagaggctttctttttagctacttctggtagacctggacctgttttggttgatgttcctaaagatattcaacaacagcttgcgattcctaattgggaacaggctatgagattacctggttatatgtctaggatgcctaaacctccggaagattctcatttggagcagattgttaggttgatttctgagtctaagaagcctgtgttgtatgttggtggtggttgtcttaattctagcgatgaattgggtaggtttgttgagcttacgggcatccctgttgcgagtacgttgatggggctgggatcttatccttgtgatgatgagttgtcgttacatatgcttggaatgcatgggactgtgtatgcaaattacgctgtggagcatagtgatttgttgttggcgtttggggtaaggtttgatgatcgtgtcacgggtaaacttgaggcttttgctagtagggctaagattgttcatattgatattgactcggctgagattgggaagaataagactcctcatgtgtctgtgtgtggtgatgttaagctggctttgcaagggatgaataaggttcttgagaaccgagcggaggagcttaaacttgattttggagtttggaggaatgagttgaacgtacagaaacagaagtttccgttgagctttaagacgtttggggaagctattcctccacagtatgcgattaaggtccttgatgagttgactgatggaaaagccataataagtactggtgtcgggcaacatcaaatgtgggcggcgcagttctacaattacaagaaaccaaggcagtggctatcatcaggaggccttggagctatgggatttggacttcctgctgcgattggagcgtctgttgctaaccctgatgcgatagttgtggatattgacggagatggaagttttataatgaatgtgcaagagctagccactattcgtgtagagaatcttccagtgaaggtacttttattaaacaaccagcatcttggcatggttatgcaatgggaagatcggttctacaaagctaaccgagctcacacatttctcggggacccggctcaggaggacgagatattcccgaacatgttgctgtttgcagcagcttgcgggattccagcggcgagggtgacaaagaaagcagatctccgagaagctattcagacaatgctggatacaccaggaccttacctgttggatgtgatttgtccgcaccaagaacatgtgttgccgatgatcccgaatggtggcactttcaacgatgtcataacggaaggagatggccggattaaatactgagagatgaaaccggtgattatcagaaccttttatggtctttgtatgcatatggtaaaaaaacttagtttgcaatttcctgtttgttttggtaatttgagtttcttttagttgttgatctgcctgctttttggtttacgtcagactactactgctgttgttgtttggtttcctttctttcattttataaataaataatccggttcggtttactccttgtgactggctcagtttggttattgcgaaatgcgaatggtaaattgagtaattgaaattcgttattagggttctaagctgttttaacagtcactgggttaatatctctcgaatcttgcatggaaaatgctcttaccattggtttttaattgaaatgtgctcatatgggccgtggtttccaaattaaataaaactacgatgtcatcgagaagtaaaatcaactgtgtccacattatcagttttgtgtatacgatgaaatagggtaattcaaaatctagcttgatatgccttttggttcattttaaccttctgtaaacattttttcagattttgaacaagtaaatccaaaaaaaaaaaaaaaaatctcaactcaacactaaattattttaatgtataaaagatgcttaaaacatttggcttaaaagaaagaagctaaaaacatagagaactcttgtaaattgaagtatgaaaatatactgaattgggtattatatgaatttttctgatttaggattcacatgatccaaaaaggaaatccagaagcactaatcagacattggaagtaggattaatcagtgatcagtaactattaaattcaattaaccgcggacatctacatttttgaattgaaaaaaaattggtaattactctttctttttctccatattgaccatcatactcattgctgatccatgtagatttcccggacatgaagccatttacaattgaatatatcctgccgccgctgccgctttgcacccggtggagcttgcatgttggtttctacgcagaactgagccggttaggcagataatttccattgagaactgagccatgtgcaccttccccccaacacggtgagcgacggggcaacggagtgatccacatgggacttttaaacatcatccgtcggatggcgttgcgagagaagcagtcgatccgtgagatcagtcgaccaattctcatgtttgacagcttatcatcgaatttctgccattcatccgcttattatcacttattcaggcgtagcaaccaggcgtttaagggcaccaataactgccttaaaaaaattacgccccgccctgccactcatcgcagtactgttgtaattcattaagcattctgccgacatggaagccatcacaaacggcatgatgaacctgaatcgccagcggcatcagcaccttgtcgccttgcgtataatatttgcccatggtgaaaacgggggcgaagaagttgtccatattggccacgtttaaatcaaaactggtgaaactcacccagggattggctgagacgaaaaacatattctcaataaaccctttagggaaataggccaggttttcaccgtaacacgccacatcttgcgaatatatgtgtagaaactgccggaaatcgtcgtggtattcactccagagcgatgaaaacgtttcagtttgctcatggaaaacggtgtaacaagggtgaacactatcccatatcaccagctcaccgtctttcattgccatacggaattccggatgagcattcatcaggcgggcaagaatgtgaataaaggccggataaaacttgtgcttatttttctttacggtctttaaaaaggccgtaatatccaggacctgcaggggggggggggcgctgaggtctgcctcgtgaagaaggtgttgctgactcataccaggcctgaatcgccccatcatccagccagaaagtgagggagccacggttgatgagagctttgttgtaggtggaccagttggtgattttgaacttttgctttgccacggaacggtctgcgttgtcgggaagatgcgtgatctgatccttcaactcagcaaaagttcgatttattcaacaaagccgccgtcccgtcaagtcagcgtaatgctctgccagtgttacaaccaattaaccaattctgattagaaaaactcatcgagcatcaaatgaaactgcaatttattcatatcaggattatcaataccatatttttgaaaaagccgtttctgtaatgaaggagaaaactcaccgaggcagttccataggatggcaagatcctggtatcggtctgcgattccgactcgtccaacatcaatacaacctattaatttcccctcgtcaaaaataaggttatcaagtgagaaatcaccatgagtgacgactgaatccggtgagaatggcaaaagcttatgcatttctttccagacttgttcaacaggccagccattacgctcgtcatcaaaatcactcgcatcaaccaaaccgttattcattcgtgattgcgcctgagcgagacgaaatacgcgatcgctgttaaaaggacaattacaaacaggaatcgaatgcaaccggcgcaggaacactgccagcgcatcaacaatattttcacctgaatcaggatattcttctaatacctggaatgctgttttcccggggatcgcagtggtgagtaaccatgcatcatcaggagtacggataaaatgcttgatggtcggaagaggcataaattccgtcagccagtttagtctgaccatctcatctgtaacatcattggcaacgctacctttgccatgtttcagaaacaactctggcgcatcgggcttcccatacaatcgatagattgtcgcacctgattgcccgacattatcgcgagcccatttatacccatataaatcagcatccatgttggaatttaatcgcggcctcgagcaagacgtttcccgttgaatatggctcataacaccccttgtattactgtttatgtaagcagacagttttattgttcatgatgatatatttttatcttgtgcaatgtaacatcagagattttgagacacaacgtggctttcccccccccccctgcaggtcctgaacggtctggttataggtacattgagcaactgactgaaatgcctcaaaatgttctttacgatgccattgggatatatcaacggtggtatatccagtgatttttttctccattttagcttccttagctcctgaaaatctcgataactcaaaaaatacgcccggtagtgatcttatttcattatggtgaaagttggaacctcttacgtgccgatcaacgtctcattttcgccaaaagttggcccagggcttcccggtatcaacagggacaccaggatttatttattctgcgaagtgatcttccgtcacaggtatttattcgcgataagctcatggagcggcgtaaccgtcgcacaggaaggacagagaaagcgcggatctgggaagtgacggacagaacggtcaggacctggattggggaggcggttgccgccgctgctgctgacggtgtgacgttctctgttccggtcacaccacatacgttccgccattcctatgcgatgcacatgctgtatgccggtataccgctgaaagttctgcaaagcctgatgggacataagtccatcagttcaacggaagtctacacgaaggtttttgcgctggatgtggctgcccggcaccgggtgcagtttgcgatgccggagtctgatgcggttgcgatgctgaaacaattatcctgagaataaatgccttggcctttatatggaaatgtggaactgagtggatatgctgtttttgtctgttaaacagagaagctggctgttatccactgagaagcgaacgaaacagtcgggaaaatctcccattatcgtagagatccgcattattaatctcaggagcctgtgtagcgtttataggaagtagtgttctgtcatgatgcctgcaagcggtaacgaaaacgatttgaatatgccttcaggaacaatagaaatcttcgtgcggtgttacgttgaagtggagcggattatgtcagcaatggacagaacaacctaatgaacacagaaccatgatgtggtctgtccttttacagccagtagtgctcgccgcagtcgagcgacagggcgaagccctcgagtgagcgaggaagcaccagggaacagcacttatatattctgcttacacacgatgcctgaaaaaacttcccttggggttatccacttatccacggggatatttttataattattttttttatagtttttagatcttcttttttagagcgccttgtaggcctttatccatgctggttctagagaaggtgttgtgacaaattgccctttcagtgtgacaaatcaccctcaaatgacagtcctgtctgtgacaaattgcccttaaccctgtgacaaattgccctcagaagaagctgttttttcacaaagttatccctgcttattgactcttttttatttagtgtgacaatctaaaaacttgtcacacttcacatggatctgtcatggcggaaacagcggttatcaatcacaagaaacgtaaaaatagcccgcgaatcgtccagtcaaacgacctcactgaggcggcatatagtctctcccgggatcaaaaacgtatgctgtatctgttcgttgaccagatcagaaaatctgatggcaccctacaggaacatgacggtatctgcgagatccatgttgctaaatatgctgaaatattcggattgacctctgcggaagccagtaaggatatacggcaggcattgaagagtttcgcggggaaggaagtggttttttatcgccctgaagaggatgccggcgatgaaaaaggctatgaatcttttccttggtttatcaaacgtgcgcacagtccatccagagggctttacagtgtacatatcaacccatatctcattcccttctttatcgggttacagaaccggtttacgcagtttcggcttagtgaaacaaaagaaatcaccaatccgtatgccatgcgtttatacgaatccctgtgtcagtatcgtaagccggatggctcaggcatcgtctctctgaaaatcgactggatcatagagcgttaccagctgcctcaaagttaccagcgtatgcctgacttccgccgccgcttcctgcaggtctgtgttaatgagatcaacagcagaactccaatgcgcctctcatacattgagaaaaagaaaggccgccagacgactcatatcgtattttccttccgcgatatcacttccatgacgacaggatagtctgagggttatctgtcacagatttgagggtggttcgtcacatttgttctgacctactgagggtaatttgtcacagttttgctgtttccttcagcctgcatggattttctcatactttttgaactgtaatttttaaggaagccaaatttgagggcagtttgtcacagttgatttccttctctttcccttcgtcatgtgacctgatatcgggggttagttcgtcatcattgatgagggttgattatcacagtttattactctgaattggctatccgcgtgtgtacctctacctggagtttttcccacggtggatatttcttcttgcgctgagcgtaagagctatctgacagaacagttcttctttgcttcctcgccagttcgctcgctatgctcggttacacggctgcggcgagcgctagtgataataagtgactgaggtatgtgctcttcttatctccttttgtagtgttgctcttattttaaacaactttgcggttttttgatgactttgcgattttgttgttgctttgcagtaaattgcaagatttaataaaaaaacgcaaagcaatgattaaaggatgttcagaatgaaactcatggaaacacttaaccagtgcataaacgctggtcatgaaatgacgaaggctatcgccattgcacagtttaatgatgacagcccggaagcgaggaaaataacccggcgctggagaataggtgaagcagcggatttagttggggtttcttctcaggctatcagagatgccgagaaagcagggcgactaccgcacccggatatggaaattcgaggacgggttgagcaacgtgttggttatacaattgaacaaattaatcatatgcgtgatgtgtttggtacgcgattgcgacgtgctgaagacgtatttccaccggtgatcggggttgctgcccataaaggtggcgtttacaaaacctcagtttctgttcatcttgctcaggatctggctctgaaggggctacgtgttttgctcgtggaaggtaacgacccccagggaacagcctcaatgtatcacggatgggtaccagatcttcatattcatgcagaagacactctcctgcctttctatcttggggaaaaggacgatgtcacttatgcaataaagcccacttgctggccggggcttgacattattccttcctgtctggctctgcaccgtattgaaactgagttaatgggcaaatttgatgaaggtaaactgcccaccgatccacacctgatgctccgactggccattgaaactgttgctcatgactatgatgtcatagttattgacagcgcgcctaacctgggtatcggcacgattaatgtcgtatgtgctgctgatgtgctgattgttcccacgcctgctgagttgtttgactacacctccgcactgcagtttttcgatatgcttcgtgatctgctcaagaacgttgatcttaaagggttcgagcctgatgtacgtattttgcttaccaaatacagcaatagtaatggctctcagtccccgtggatggaggagcaaattcgggatgcctggggaagcatggttctaaaaaatgttgtacgtgaaacggatgaagttggtaaaggtcagatccggatgagaactgtttttgaacaggccattgatcaacgctcttcaactggtgcctggagaaatgctctttctatttgggaacctgtctgcaatgaaattttcgatcgtctgattaaaccacgctgggagattagataatgaagcgtgcgcctgttattccaaaacatacgctcaatactcaaccggttgaagatacttcgttatcgacaccagctgccccgatggtggattcgttaattgcgcgcgtaggagtaatggctcgcggtaatgccattactttgcctgtatgtggtcgggatgtgaagtttactcttgaagtgctccggggtgatagtgttgagaagacctctcgggtatggtcaggtaatgaacgtgaccaggagctgcttactgaggacgcactggatgatctcatcccttcttttctactgactggtcaacagacaccggcgttcggtcgaagagtatctggtgtcatagaaattgccgatgggagtcgccgtcgtaaagctgctgcacttaccgaaagtgattatcgtgttctggttggcgagctggatgatgagcagatggctgcattatccagattgggtaacgattatcgcccaacaagtgcttatgaacgtggtcagcgttatgcaagccgattgcagaatgaatttgctggaaatatttctgcgctggctgatgcggaaaatatttcacgtaagattattacccgctgtatcaacaccgccaaattgcctaaatcagttgttgctcttttttctcaccccggtgaactatctgcccggtcaggtgatgcacttcaaaaagcctttacagataaagaggaattacttaagcagcaggcatctaaccttcatgagcagaaaaaagctggggtgatatttgaagctgaagaagttatcactcttttaacttctgtgcttaaaacgtcatctgcatcaagaactagtttaagctcacgacatcagtttgctcctggagcgacagtattgtataagggcgataaaatggtgcttaacctggacaggtctcgtgttccaactgagtgtatagagaaaattgaggccattcttaaggaacttgaaaagccagcaccctgatgcgaccacgttttagtctacgtttatctgtctttacttaatgtcctttgttacaggccagaaagcataactggcctgaatattctctctgggcccactgttccacttgtatcgtcggtctgataatcagactgggaccacggtcccactcgtatcgtcggtctgattattagtctgggaccacggtcccactcgtatcgtcggtctgattattagtctgggaccacggtcccactcgtatcgtcggtctgataatcagactgggaccacggtcccactcgtatcgtcggtctgattattagtctgggaccatggtcccactcgtatcgtcggtctgattattagtctgggaccacggtcccactcgtatcgtcggtctgattattagtctggaaccacggtcccactcgtatcgtcggtctgattattagtctgggaccacggtcccactcgtatcgtcggtctgattattagtctgggaccacgatcccactcgtgttgtcggtctgattatcggtctgggaccacggtcccacttgtattgtcgatcagactatcagcgtgagactacgattccatcaatgcctgtcaagggcaagtattgacatgtcgtcgtaacctgtagaacggagtaacctcggtgtgcggttgtatgcctgctgtggattgctgctgtgtcctgcttatccacaacattttgcgcacggttatgtggacaaaatacctggttacccaggccgtgccggcacgtttcctacaaggtagaatccgcctgagtcgcaagggtgacttcgcctatattggacgacggcgcgcagagggcgacctctttttgggttacgattgtaggattatcactaaaacaatacatgaacatattcaaatggcaatctctctaaggcattggaaataaatacaaataacagttgggtggagtttttcgacctgagggcgttaactcttcaaggacaacaagaccgtggacgtcgagcggctctccgacaagcatgtcgcccgcctggtcaagcagaccgcactcgccgccggcgcttcgataccgttcgtattggtccggcgaaactgtgagtatccgcatcgtaatctccgcatgaacaggtcatgcgaacagaaatcatctcacggtgcgtttgcctacgtgcagatttgcacctcaggtgattctaccgagtcggtgttccaaggcgcgaaatgcgagcgggtgaggccgaccagacgccgacaaggttgtgcagatctgcacttggtgccacgtcgcacagaagaagggaatcggtctaactcacagatagcatttgaagaatcgggatttagtgtgatttcgattgaaacgcgcgtaaccgttcattaaccaaaaacgtcttgcaacctcacccgcattaggtaatcgtcacggataaatggcaatacgcgccaattaaccgtgacaagagataacaccgtgagcaaagccgctgccatatcccgaaatgatcgcccgtcggtagatgttaccattggtgagcatgctgagcagctcagctctcagcttcaagcgatgagcgaggctttgtttcctccgacgtcgcacaagagcttgcgcaaattcacctcgggtgaagccgcacgcttgatgaaaatatctgactcaactcttcgaaagatgacactggctggcgaagggccgcaacctgaactcgccagcaacggacggcgcttttacaccctcggtcagataaacgaaatccggcagatgcttgccggctcgactcgaggacgtgaaagcattgattttgtgcctcatcgccgaggttctgagcatttgcaagtcgttgctgtaaccaacttcaaaggtggctctgggaagacgacgacgtccgctcatcttgcacagtatctggcgttgcaaggttacagggttctcgcagtcgatctcgatccgcaggctagtctttcagcactcctcggcgttctgccagaaactgatgtcggtgcaaacgaaacgctctatgcggctattcggtacgacgacacacgtcgtccgttgcgagatgtgatccgaccgacgtattttgatggtcttcaccttgttcctggaaatctcgagcttatggagttcgagcataccaccccgaaagcattgactgacaaaggtacgcgcgacggattgttcttcactcgcgtggcccaagcctttgatgaggtcgccgacgattacgatgtcgtggtcatcgactgccctcctcagcttgggtttttgactctcagcgggttgtgtgctgcaacatcaatggtaatcaccgtacatcctcagatgctggatatcgcttccatgagccagtttctcctcatgacacgcgaccttctgggtgtcgtgaaagaggcggggggcaatctccagtacgatttcatacgctatctcttgacgcgctatgagccccaggacgcgccgcagacgaaagtgacggcactgctgcgcaacatgttcgaggatcacgtccttacaaatcctatggtcaagtcggcagcggtatctgatgccggtttaaccaagcagacgctctatgagatagggcgagagaaccttacgcgatcgacatacgaccgggcgatggaatctttagatgcggtgaattcggagatcgaggctttgatcaagatggcgtgggggcgggtctaatgaaaggctttgcgttcctcacagatctgttgggagctcccaacagacaggtgttgattcgccccctggacatggggcactggagaagccggggtaatttgagacgacgacgcacgcccatcgctaattggccagggtgcagttgtcttgtcttgttgggagctcccaaccaagcgcatttgcaatcaaaaatgcgacgccacgacgccaaacccaagaggccgatatcatgagccgcaaagacgcaatcgatactttgttcctcaagaagcaacctgcgaccgatagagcagcagtcgacaagtcgaccgctcgtgttcgtaccggagcgatttcggccatgggttcgtctttgcaagagatggctgagggcgcaaaggctgcagctcggctgcaggatcaactggctacaggcgaagccgtcgtgtccctggatccatccatgatcgacgggtcgccgatcgcggatcggctgccctcagacgtggatccgaaattcgagcagcttgaggcgagcatttcgcaggaggggcagcaggtgccggttcttgtcagaccgcaccctgaggctgccggtcgatatcagatcgtatatggaaggcggcggctgcgcgcggcagtaaatctgcggagagaggtttctgccattgttcgaaatctcacggactgtgaactggtcgtggcccagggccgcgaaaatcttaaccgcgctgacctctcgttcattgagaaggctctcttcgccctgcgcctcgaagatgcgggttttgatagagccaccatcattgccgcgctatccactgacaaggccgacctcagccgctacataactgtagcaaggggcataccgctgaacctcgccacacaaatcggcccagcgtcgaaagcgggtcgatcgcgttgggtcgtacttgccgaggggcttgggaagcctaaggcaacggacgcaatcgaagcgatgcttgggtcagagcagttcaagcaatctgatagcgatacccgctttaacctcattttcaacgccgtttcaaggccacctgcgaagactccaaaaaaggtaagggcctggagcacgccaaaggggaaaaaggcagcgacgatccgacaagaaactggacgaacggcgctggttttcgacgagagactggtgccaacttttggcgaatatgtcgctgaccagttggacagtctgtacgcccagttcattgaaaccaacggaggaggcaagctcgaccaatagtcagggtttcatccaatttaaagctccgctcgactgagatggactggctctcaccgcaaaagaaaaaggcccccgaaacggcgttccggaagaccttctctgtagtctcgcagctaagagaatcgcatttccaggaatcgtagtcaagggtcccgtaagggaaagcgtcatttcgacgggcggatttcaattgcctaacaaaaggtaaaaggaaatgcagacgcatatctcaacgacgtcctttgggcggcggccgatgacactcggccatattgcaagccagatggcagcaaaagcggtcgcatcagacactgtcgcccacaaatggcaggtcttccagcacatccgtgaatcccggggactgatcggagccacggaccgctcactctcgatcctgaacgcgctgttgacgttttacccggagaccgccttgactggtggtgccgaactggtcgtatggccttctaacgaacagctgatggctcgcgccaacggcatgcccgccacgacactgcgccggcatcttgccatactggttgattgcgggctcatcattcgccgcgacagccccaatggcaagcggttcgcccgcaagggaaggggaggggagattgagcaggcctatgggttcgatctgtcgccgatcgtcgcgcgggccgaggagttccgagatctggcccagacagtgcaagctgaaaaaaaggccttccgggtggccaaggagcgcttgactcttcttcgtcgtgacattgtcaaaatgatcgaaactggcgtcgaagagagcgttcctggaaactggggaagagttacccagacctatcaggggatcatcggccgcctgccacgctcggcacctcggcagcttgtcgagagtattgggcaagagcttcaggaactctgcatcgagatccgtgacgtattggaatctttcacaaaaacgatgaatctggacgccaatgagtcccatatcggtcgccacaaacagaattcaaatccagactctaaatttgaatctgaatacagctctggaaaaaaagatgaagcgggcggcagcgttgcggaaaccgacaatgtacggagcttgccgaaacgcgagctgcctttgggaatcgtgctggatgcctgccccgaaatgcgggaattggcccagggaggtccaattcggcattggcgcgacttgctggcggcggctgagcttgcccggccgatgctggggattagtccgagcgcctggcgggaggcccgcgaaaccatgggcgatcaacacgcggcgatcacgctggcttcgatctatcagcgggccggtcagatcaataacgctgggggctatctgcgcagcctgaccgaccgggccaaggatgggaagttttcgacctggccgatggtcatggcgttgctccgggcaaagctggacgagcagaagaatgcagttggcgctggaaagccgcgaactgctgaggaggtcgaggatgacagccgcctccacgtatcggaatcgctgctcaaaaacctgcgaaagccgagatcttggtgatcctctcgctattcagccgcggcgatgtcgacgtcggtgatcaacccggaacgtcgggcgcggtcgatcaggttcttgacggacgagggcgcccatttggatccaccgcgcggcgtgcgctcgtgcagtctttcaagctggccggcgatctcgcggagcttcaggtctgggttcgaagaatggatgccggccacaagcgtcatcaggcgatcttcgggaagacggggaggagattttttcaggagcgctgcatccaccaggcgttccgtcaccatccacttcacggctcggcgaagacgttctggcgtccagtcgaggccccgctgcttgagcattcgggcgatgtcgtcccatgtgtgatccggtcgcatgcgacgaacggtaggaagccattggttcgcggacgcctgaatcctatcgccatatgccgctttctgggccgcggtcatccttgccagcgcctccgggcgcttttcccggatgcccgggttgccggaaagcttccctaggcacaaacgttgactcttggatcgagctggcagacaaagcaataacccacacagaggacgattaatggctgacgaagagatccagaatccgccggacggtactgctgctgccgaagttgagccggctgctcctagaggtagaagagcaaagaaagcaccagccgaaacagcccgcacgggatcgttcaaatccgtgaagccgaaaacccgcggcctcagcaaccgagaaaaactggagaagatcggtcaaatcgaagctcaggtcgctggcggcgcaaccttgaaggacgccgttaagatcgtgggtatttccgttcagacctattatcaatggaagagagctgcggttcaacctgtctcacagaatccggccgtgtctgtttcagttgacgatgaactcggcgagttcatccaactcgaggaggaaaatcggcggctcagaaagcttcacgctgccgcaagcactcagggcgcaagggctgctaaaggaagcggaacacgtagaaagccagtccgcagaaacggtgctgaccccggatgaatgtcagctactgggctatctggacaagggaaaacgcaagcgcaaagagaaagcaggtagcttgcagtgggcttacatggcgatagctagactgggcggttttatggacagcaagcgaaccggaattgccagctggggcgccctctgggaaggttgggaagccctgcaaagtaaactggatggctttcttgccgccaaggatctgatggcgcaggggatcaagatctgatcaagagacaggggccggcccacgctgtcgtccaatctcccaagacacgccgccaccgcgcaccgtcgcggcgagctgctccccaagccgctgttcgatgggcttccaccgcacgaggctggaccccttggcgtcatcaagcatcccatttcgcccgctggcgagcatgacggggcgccggtagacgccggcaacgcgctggccgtcggccacggggcgatgctccaggccggtatcggcggcaatgtccttcgcggcctgcgccagttcccgagcccgctgctgcccagcagattccggtgaggatcacgcgctgcccgcgccgctcggccagtccctgttcggccaggaagtccgcgcgctgctgtatcgcctacttggcctcactgctaaagcccaggtcgcccaagcccgagccaccgtcgatcaactgctggtcaagccaggtggcaccgatcacgcgggcctgccgctcgatgggcaggtgcgatttcagctccaccgtcacgccaccaagacgctgggcgtcatagcggcggccctgctcgggcagatcgtccggcaccttccatagtccctcggccacgcacaccacgatgccggcctggtgcagggcttcgaggcggcgggtgtggcccgcaacgacttccagcggatcacgcccgacacggcctgacctagctcgacgaccaggtgagatcggtgaccgcgctagtcaagcaaccggcgtgccatggcgtttacggccagatcaatcgcagcgccctcgccctcgccgtcgccgtcgccgatgaaccaggctgccgacaagcccgtccatgcaatgatccagcgaagaagccgttcgggctcaaacccggtcgtcgcgaccacaatgctgagtcgagcctccagcctgcccggcaggatcgcaagcgggcgaccggggtcgctgagatcgggattcgtgaagatgttggcatagtcgaaggtgcgctcgccgagcagtccgtgcgggtcgatggccagccagccgcggtcgccgaagtcgagcacgttctcgtggtgcaggtcgccgtggagcgggcacacctcgcgcggcgccgccagaagttggcgcgctacgctggcggcgggcgcaagtgccgcgtgctcagcggccaaccggaaaagcggctggaaccattcctgtagcggatggagatcgggcggcggtccggaccgcggcgcgtgcagacgagcggcggtgtcgcagaggatcgtggcatcaccgaaccgcgccgtgcgcgggtcgtcggtgagccagagtttcagcaggccgcccaggcggcccaggtcgccattgatgcgggccagctcgcggacgtgctcatagtccacgacgcccgtgattttgtagccctggccgacggccagcaggtaggccgacaggctcatgccggccgccgccgccttttcctcaatcgctcttcgttcgtctggaaggcagtacaccttgataggtgggctgcccttcctggttggcttggtttcatcagccatccgcttgccctcatctgttacgccggcggtagccggccagcctcgcagagcaggattcccgttgagcaccgccaggtgcgaataagggacagtgaagaaggaacacccgctcgcgggtgggcctacttcacctatcctgcccggctgacgccgttggatacaccaaggaaagtctacacgaaccctttggcaaaatcctgtatatcgtgcgaaaaaggatggatataccgaaaaaatcgctataatgaccccgaagcagggttatgcagcggaaaagcgctgcttccctgctgttttgtggaatatctaccgactggaaacaggcaaatgcaggaaattactgaactgaggggacaggcgagagacgatgccaaagagctacaccgacgagctggccgagtgggttgaatcccgcgcggccaagaagcgccggcgtgatgaggctgcggttgcgttcctggcggtgagggcggatgtcgaggcggcgttagcgtccggctatgcgctcgtcaccatttgggagcacatgcgggaaacggggaaggtcaagttctcctacgagacgttccgctcgcacgccaggcggcacatcaaggccaagcccgccgatgtgcccgcaccgcaggccaaggctgcggaacccgcgccggcacccaagacgccggagccacggcggccgaagcaggggggcaaggctgaaaagccggcccccgctgcggccccgaccggcttcaccttcaacccaacaccggacaaaaaggatcaaccgggctgcatccgatgcaagtgtgtcgctgtcgactcgttgtacaacgaaatccattcccattccgcgctcaagatggcttcccctcggcagttcatcagggctaaatcaatctagccgacttgtccggtgaaatgggctgcactccaacagaaacaatcaaacaaacatacacagcgacttattcacacgagctcaaattacaacggtatatat

SEQ ID NO: 4 - DNA, 61092 bp, Artificial Sequence
  plasmid
cctgccagtcagcatcatcacaccaaaagttaggcccgaatagtttgaaattagaaagctcgcaattgaggtctacaggccaaattcgctcttagccgtacaatattactcaccggtgcgatgccccccatcgtaggtgaaggtggaaattaatggcgcgcctgatcactgattagtaactattacgtaagcctacgtagcgtcacgtgacgttagctaacgctacgtagcctcagctgacgttacgtaagcctacgtagcgtcacgtgagcttagctaacgctacctaggctcagctgacgttacgtaacgctagctagcgtcactcctgcagcaaatttacacattgccactaaacgtctaaacccttgtaatttgtttttgttttactatgtgtgttatgtatttgatttgcgataaatttttatatttggtactaaatttataacaccttttatgctaacgtttgccaacacttagcaatttgcaagttgattaattgattctaaattatttttgtcttctaaatacatatactaatcaactggaaatgtaaatatttgctaatatttctactataggagaattaaagtgagtgaatatggtaccacaaggtttggagatttaattgttgcaatgctgcatggatggcatatacaccaaacattcaataattcttgaggataataatggtaccacacaagatttgaggtgcatgaacgtcacgtggacaaaaggtttagtaatttttcaagacaacaatgttaccacacacaagttttgaggtgcatgcatggatgccctgtggaaagtttaaaaatattttggaaatgatttgcatggaagccatgtgtaaaaccatgacatccacttggaggatgcaataatgaagaaaactacaaatttacatgcaactagttatgcatgtagtctatataatgaggattttgcaatactttcattcatacacactcactaagttttacacgattataatttcttcatagccagtactgtttaagcttcactgtctctgaatcggcaaaggtaaacgtatcaattattctacaaacccttttatttttcttttgaattaccgtcttcattggttatatgataacttgataagtaaagcttcaataattgaatttgatctgtgtttttttggccttaatactaaatccttacataagctttgttgcttctcctcttgtgagttgagtgttaagttgtaataatggttcactttcagctttagaagaaaccatggaagttgttgagaggttctacggagagttggatggaaaggtttcccaaggagtgaacgctttgttgggatctttcggagttgagttgactgataccccaactactaagggattgccactcgttgattctccaactccaattgtgttgggagtgtctgtttacttgaccatcgtgatcggaggattgctttggatcaaggctagagatctcaagccaagagcttctgagccattcttgttgcaagctttggtgttggtgcacaacttgttctgcttcgctttgtctctttacatgtgcgtgggtatcgcttaccaagctatcacctggagatattccttgtggggaaacgcttataacccaaagcacaaggagatggctatcctcgtttacctcttctacatgtccaagtacgtggagttcatggataccgtgatcatgatcctcaagagatccaccagacagatttctttcctccacgtgtaccaccactcttctatctcccttatctggtgggctattgctcaccacgctccaggaggagaggcttattggagtgctgctctcaactctggagtgcacgtgttgatgtacgcttactacttcttggctgcttgcttgagatcttccccaaagctcaagaacaagtacctcttctggggaagatacctcacccaattccagatgttccagttcatgctcaacttggtgcaagcttactacgatatgaaaaccaacgctccatatccacaatggctcatcaagatcctcttctactacatgatctccctcttgttcctcttcggaaacttctacgtgcaaaagtacatcaagccatccgatggaaagcaaaagggagctaagaccgagtgatcgacaagctcgagtttctccataataatgtgtgagtagttcccagataagggaattagggttcctatagggtttcgctcatgtgttgagcatataagaaacccttagtatgtatttgtatttgtaaaatacttctatcaataaaatttctaattcctaaaaccaaaatccagtactaaaatccagatcccccgaattaattcggcgttaattcagctagctagcctcagctgacgttacgtaacgctaggtagcgtcacgtgacgttagctaacgctaggtagcgtcagctgagcttacgtaagcgcttagcagatatttggtgtctaaatgtttattttgtgatatgttcatgtttgaaatggtggtttcgaaaccagggacaacgttgggatctgatagggtgtcaaagagtattatggattgggacaatttcggtcatgagttgcaaattcaagtatatcgttcgattatgaaaattttcgaagaatatcccatttgagagagtctttacctcattaatgtttttagattatgaaattttatcatagttcatcgtagtctttttggtgtaaaggctgtaaaaagaaattgttcacttttgttttcgtttatgtgaaggctgtaaaagattgtaaaagactattttggtgttttggataaaatgatagtttttatagattcttttgcttttagaagaaatacatttgaaattttttccatgttgagtataaaataccgaaatcgattgaagatcatagaaatattttaactgaaaacaaatttataactgattcaattctctccatttttatacctatttaaccgtaatcgattctaatagatgatcgattttttatataatcctaattaaccaacggcatgtattggataattaaccgatcaactctcacccctaatagaatcagtattttccttcgacgttaattgatcctacactatgtaggtcatatccatcgttttaatttttggccaccattcaattctgtcttgcctttagggatgtgaatatgaacggccaaggtaagagaataaaaataatccaaattaaagcaagagaggccaagtaagataatccaaatgtacacttgtcattgccaaaattagtaaaatactcggcatattgtattcccacacattattaaaataccgtatatgtattggctgcatttgcatgaataatactacgtgtaagcccaaaagaacccacgtgtagcccatgcaaagttaacactcacgaccccattcctcagtctccactatataaacccaccatccccaatctcaccaaacccaccacacaactcacaactcactctcacaccttaaagaaccaatcaccaccaaaaaatttcacgatttggaatttgattcctgcgatcacaggtatgacaggttagattttgttttgtatagttgtatacatacttctttgtgatgttttgtttacttaatcgaatttttggagtgttttaaggtctctcgtttagaaatcgtggaaaatatcactgtgtgtgtgttcttatgattcacagtgtttatgggtttcatgttctttgttttatcattgaatgggaagaaatttcgttgggatacaaatttctcatgttcttactgatcgttattaggagtttggggaaaaaggaagagtttttttggttggttcgagtgattatgaggttatttctgtatttgatttatgagttaatggtcgttttaatgttgtagaccatgggaaaaggatctgagggaagatctgctgctagagagatgactgctgaggctaacggagataagagaaagaccatcctcattgagggagtgttgtacgatgctaccaacttcaaacacccaggaggttccattattaacttcctcaccgagggagaagctggagttgatgctacccaagcttacagagagttccatcagagatccggaaaggctgataagtacctcaagtccctcccaaagttggatgcttctaaggtggagtctaggttctctgctaaggagcaggctagaagggacgctatgaccagggattacgctgctttcagagaggagttggttgctgagggatacttcgatccatctatcccacacatgatctacagagtggtggagattgtggctttgttcgctttgtctttctggttgatgtctaaggcttctccaacctctttggttttgggagtggtgatgaacggaatcgctcaaggaagatgcggatgggttatgcacgagatgggacacggatctttcactggagttatctggctcgatgataggatgtgcgagttcttctacggagttggatgtggaatgtctggacactactggaagaaccagcactctaagcaccacgctgctccaaacagattggagcacgatgtggatttgaacaccttgccactcgttgctttcaacgagagagttgtgaggaaggttaagccaggatctttgttggctttgtggctcagagttcaggcttatttgttcgctccagtgtcttgcttgttgatcggattgggatggaccttgtacttgcacccaagatatatgctcaggaccaagagacacatggagtttgtgtggatcttcgctagatatatcggatggttctccttgatgggagctttgggatattctcctggaacttctgtgggaatgtacctctgctctttcggacttggatgcatctacatcttcctccaattcgctgtgtctcacacccacttgccagttaccaacccagaggatcaattgcactggcttgagtacgctgctgatcacaccgtgaacatctctaccaagtcttggttggttacctggtggatgtctaacctcaacttccaaatcgagcaccacttgttcccaaccgctccacaattcaggttcaaggagatctctccaagagttgaggctctcttcaagagacacaacctcccttactacgatttgccatacacctctgctgtttctactaccttcgctaacctctactctgttggacactctgttggagctgataccaagaagcaggattgactgctttaatgagatatgcgagacgcctatgatcgcatgatatttgctttcaattctgttgtgcacgttgtaaaaaacctgagcatgtgtagctcagatccttaccgccggtttcggttcattctaatgaatatatcacccgttactatcgtatttttatgaataatattctccgttcaatttactgattgtctacgtaggctcagctgagcttacctaaggctacgtaggctcacgtgacgttacgtaaggctacgtagcgtcacgtgagcttacctaactctagctagcctcacgtgaccttagctaacactaggtagcgtcagctcgacggcccggactgtatccaacttctgatctttgaatctctctgttccaacatgttctgaaggagttctaagacttttcagaaagcttgtaacatgctttgtagactttctttgaattactcttgcaaactctgattgaacctacgtgaaaactgctccagaagttctaaccaaattccgtcttgggaaggcccaaaatttattgagtacttcagtttcatggacgtgtcttcaaagatttataacttgaaatcccatcatttttaagagaagttctgttccgcaatgtcttagatctcattgaaatctacaactcttgtgtcagaagttcttccagaatcaacttgcatcatggtgaaaatctggccagaagttctgaacttgtcatatttcttaacagttagaaaaatttctaagtgtttagaattttgacttttccaaagcaaacttgacttttgactttcttaataaaacaaacttcatattctaacatgtcttgatgaaatgtgattcttgaaatttgatgttgatgcaaaagtcaaagtttgacttttcagtgtgcaattgaccattttgctcttgtgccaattccaaacctaaattgatgtatcagtgctgcaaacttgatgtcatggaagatcttatgagaaaattcttgaagactgagaggaaaaattttgtagtacaacacaaagaatcctgtttttcatagtcggactagacacattaacataaaacaccacttcattcgaagagtgattgaagaaggaaatgtgcagttacctttctgcagttcataagagcaacttacagacacttttactaaaatactacaaagaggaagattttaacaacttagagaagtaatgggagttaaagagcaacacattaagggggagtgttaaaattaatgtgttgtaaccaccactacctttagtaagtattataagaaaattgtaatcatcacattataattattgtccttatttaaaattatgataaagttgtatcattaagattgagaaaaccaaatagtcctcgtcttgatttttgaattattgttttctatgttacttttcttcaagcctatataaaaactttgtaatgctaaattgtatgctggaaaaaaatgtgtaatgaattgaatagaaattatggtatttcaaagtccaaaatccatcaatagaaatttagtacaaaacgtaactcaaaaatattctcttattttaaattttacaacaatataaaaatattctcttattttaaattttacaataatataatttatcacctgtcacctttagaataccaccaacaatattaatacttagatattttattcttaataattttgagatctctcaatatatctgatatttattttatatttgtgtcatattttcttatgttttagagttaacccttatatcttggtcaaactagtaattcaatatatgagtttgtgaaggacacattgacatcttgaaacattggttttaaccttgttggaatgttaaaggtaataaaacattcagaattatgaccatctattaatatacttcctttgtcttttaaaaaagtgtgcatgaaaatgctctatggtaagctagagtgtcttgctggcctgtgtatatcaattccatttccagatggtagaaactgccactacgaataattagtcataagacacgtatgttaacacacgtccccttgcatgttttttgccatatattccgtctctttctttttcttcacgtataaaacaatgaactaattaatagagcgatcaagctgaacagttctttgctttcgaagttgccgcaacctaaacaggtttttccttcttctttcttcttattaactacgaccttgtcctttgcctatgtaaaattactaggttttcatcagttacactgattaagttcgttatagtggaagataaaatgccctcaaagcattttgcaggatatctttgatttttcaaagatatggaactgtagagtttgatagtgttcttgaatgtggttgcatgaagtttttttggtctgcatgttattttttcctcgaaatatgttttgagtccaacaagtgattcacttgggattcagaaagttgttttctcaatatgtaacagtttttttctatggagaaaaatcatagggaccgttggttttggcttctttaattttgagctcagattaaacccattttacccggtgttcttggcagaattgaaaacagtacgtagtaccgcgcctaccatgtgtgttgagaccgagaacaacgatggaatccctactgtggagatcgctttcgatggagagagagaaagagctgaggctaacgtgaagttgtctgctgagaagatggaacctgctgctttggctaagaccttcgctagaagatacgtggttatcgagggagttgagtacgatgtgaccgatttcaaacatcctggaggaaccgtgattttctacgctctctctaacactggagctgatgctactgaggctttcaaggagttccaccacagatctagaaaggctaggaaggctttggctgctttgccttctagacctgctaagaccgctaaagtggatgatgctgagatgctccaggatttcgctaagtggagaaaggagttggagagggacggattcttcaagccttctcctgctcatgttgcttacagattcgctgagttggctgctatgtacgctttgggaacctacttgatgtacgctagatacgttgtgtcctctgtgttggtttacgcttgcttcttcggagctagatgtggatgggttcaacacgagggaggacactcttctttgaccggaaacatctggtgggataagagaatccaagctttcactgctggattcggattggctggatctggagatatgtggaactccatgcacaacaagcaccacgctactcctcaaaaagtgaggcacgatatggatttggataccactcctgctgttgctttcttcaacaccgctgtggaggataatagacctaggggattctctaagtactggctcagattgcaagcttggaccttcattcctgtgacttctggattggtgttgctcttctggatgttcttcctccacccttctaaggctttgaagggaggaaagtacgaggagcttgtgtggatgttggctgctcacgtgattagaacctggaccattaaggctgttactggattcaccgctatgcaatcctacggactcttcttggctacttcttgggtttccggatgctacttgttcgctcacttctctacttctcacacccacttggatgttgttcctgctgatgagcacttgtcttgggttaggtacgctgtggatcacaccattgatatcgatccttctcagggatgggttaactggttgatgggatacttgaactgccaagtgattcaccacctcttcccttctatgcctcaattcagacaacctgaggtgtccagaagattcgttgctttcgctaagaagtggaacctcaactacaaggtgatgacttatgctggagcttggaaggctactttgggaaacctcgataatgtgggaaagcactactacgtgcacggacaacactctggaaagaccgcttgattaatgaaggccgcctcgaccgtaccccctgcagatagactatactatgttttagcctgcctgctggctagctactatgttatgttatgttgtaaaataaacacctgctaaggtatatctatctatattttagcatggctttctcaataaattgtctttccttatcgtttactatcttatacctaataatgaaataataatatcacatatgaggaacggggcaggtttaggcatatatatacgagtgtagggcggagtggggctacgtagcgtcacgtgacgttacctaagcctaggtagcctcagctgacgttacgtaacgctaggtaggctcagctgacacgggcaggacatagggactactacaagcatagtatgcttcagacaaagagctaggaaagaactcttgatggaggttaagagaaaaaagtgctagaggggcatagtaatcaaacttgtcaaaaccgtcatcatgatgagggatgacataatataaaaagttgactaaggtcttggtagtactctttgattagtattatatattggtgagaacatgagtcaagaggagacaagaaaccgaggaaccatagtttagcaacaagatggaagttgcaaagttgagctagccgctcgattagttacatctcctaagcagtactacaaggaatggtctctatactttcatgtttagcacatggtagtgcggattgacaagttagaaacagtgcttaggagacaaagagtcagtaaaggtattgaaagagtgaagttgatgctcgacaggtcaggagaagtccctccgccagatggtgactaccaaggggttggtatcagctgagacccaaataagattcttcggttgaaccagtggttcgaccgagactcttagggtgggatttcactgtaagatttgtgcattttgttgaatataaattgacaattttttttatttaattatagattatttagaatgaattacatatttagtttctaacaaggatagcaatggatgggtatgggtacaggttaaacatatctattacccacccatctagtcgtcgggttttacacgtacccacccgtttacataaaccagaccggaattttaaaccgtacccgtccgttagcgggtttcagatttacccgtttaatcgggtaaaacctgattactaaatatatattttttatttgataaacaaaacaaaaatgttaatattttcatattggatgcaattttaagaaacacatattcataaatttccatatttgtaggaaaataaaaagaaaaatatattcaagaacacaaatttcaccgacatgacttttattacagagttggaattagatctaacaattgaaaaattaaaattaagatagaatatgttgaggaacatgacatagtataatgctgggttacccgtcgggtaggtatcgaggcggatactactaaatccatcccactcgctatccgataatcactggtttcgggtatacccattcccgtcaacaggcctttttaaccggataatttcaacttatagtgaatgaattttgaataaatagttagaataccaaaatcctggattgcatttgcaatcaaattttgtgaaccgttaaattttgcatgtacttgggatagatataatagaaccgaattttcattagtttaatttataacttactttgttcaaagaaaaaaaatatctatccaatttacttataataaaaaataatctatccaagttacttattataatcaacttgtaaaaaggtaagaatacaaatgtggtagcgtacgtgtgattatatgtgacgaaatgttatatctaacaaaagtccaaattcccatggtaaaaaaaatcaaaatgcatggcaggctgtttgtaaccttggaataagatgttggccaattctggagccgccacgtacgcaagactcagggccacgttctcttcatgcaaggatagtagaacaccactccacccacctcctatattagacctttgcccaaccctccccaactttcccatcccatccacaaagaaaccgacatttttatcataaatctggtgcttaaacactctggtgagttctagtacttctgctatgatcgatctcattaccatttcttaaatttctctccctaaatattccgagttcttgatttttgataacttcaggttttctctttttgataaatctggtctttccatttttttttttttgtggttaatttagtttcctatgttcttcgattgtattatgcatgatctgtgtttggattctgttagattatgtattggtgaatatgtatgtgtttttgcatgtctggttttggtcttaaaaatgttcaaatctgatgatttgattgaagcttttttagtgttggtttgattcttctcaaaactactgttaatttactatcatgttttccaactttgattcatgatgacacttttgttctgctttgttataaaattttggttggtttgattttgtaattatagtgtaattttgttaggaatgaacatgttttaatactctgttttcgatttgtcacacattcgaattattaatcgataatttaactgaaaattcatggttctagatcttgttgtcatcagattatttgtttcgataattcatcaaatatgtagtccttttgctgatttgcgactgtttcattttttctcaaaattgttttttgttaagtttatctaacagttatcgttgtcaaaagtctctttcattttgcaaaatcttctttttttttttgtttgtaactttgttttttaagctacacatttagtctgtaaaatagcatcgaggaacagttgtcttagtagacttgcatgttcttgtaacttctatttgtttcagtttgttgatgactgctttgattttgtaggtcaaaggcgcaccctaccatggatgcttataacgctgctatggataagattggagctgctatcatcgattggagtgatccagatggaaagttcagagctgatagggaggattggtggttgtgcgatttcagatccgctatcaccattgctctcatctacatcgctttcgtgatcttgggatctgctgtgatgcaatctctcccagctatggacccataccctatcaagttcctctacaacgtgtctcaaatcttcctctgcgcttacatgactgttgaggctggattcctcgcttataggaacggatacaccgttatgccatgcaaccacttcaacgtgaacgatccaccagttgctaacttgctctggctcttctacatctccaaagtgtgggatttctgggataccatcttcattgtgctcggaaagaagtggagacaactctctttcttgcacgtgtaccaccacaccaccatcttcctcttctactggttgaacgctaacgtgctctacgatggagatatcttcttgaccatcctcctcaacggattcattcacaccgtgatgtacacctactacttcatctgcatgcacaccaaggattctaagaccggaaagtctttgccaatctggtggaagtcatctttgaccgctttccaactcttgcaattcaccatcatgatgtcccaagctacctacttggttttccacggatgcgataaggtttccctcagaatcaccatcgtgtacttcgtgtacattctctcccttttcttcctcttcgctcagttcttcgtgcaatcctacatggctccaaagaagaagaagtccgcttgatgttaatgaaggccgcagatatcagatctggtcgacctagaggatccccggccgcaaagataataacaaaagcctactatataacgtacatgcaagtattgtatgatattaatgtttttacgtacgtgtaaacaaaaataattacgtttgtaacgtatggtgatgatgtggtgcactaggtgtaggccttgtattaataaaaagaagtttgttctatatagagtggtttagtacgacgatttatttactagtcggattggaatagagaaccgaattcttcaatccttgcttttgatcaagaattgaaaccgaatcaaatgtaaaagttgatatatttgaaaaacgtattgagcttatgaaaatgctaatactctcatctgtatggaaaagtgactttaaaaccgaacttaaaagtgacaaaaggggaatatcgcatcaaaccgaatgaaaccgatctacgtaggctcagctgagcttagctaagcctacctagcctcacgtgagattatgtaaggctaggtagcgtcacgtgacgttacctaacactagctagcgtcagctgagcttagctaaccctacgtagcctcacgtgagcttacctaacgctacgtagcctcacgtgactaaggatgacctacccattcttgagacaaatgttacattttagtatcagagtaaaatgtgtacctataactcaaattcgattgacatgtatccattcaacataaaattaaaccagcctgcacctgcatccacatttcaagtattttcaaaccgttcggctcctatccaccgggtgtaacaagacggattccgaatttggaagattttgactcaaattcccaatttatattgaccgtgactaaatcaactttaacttctataattctgattaagctcccaatttatattcccaacggcactacctccaaaatttatagactctcatccccttttaaaccaacttagtaaacgttttttttttaattttatgaagttaagtttttaccttgtttttaaaaagaatcgttcataagatgccatgccagaacattagctacacgttacacatagcatgcagccgcggagaattgtttttcttcgccacttgtcactcccttcaaacacctaagagcttctctctcacagcacacacatacaatcacatgcgtgcatgcattattacacgtgatcgccatgcaaatctcctttatagcctataaattaactcatcggcttcactctttactcaaaccaaaactcatcaatacaaacaagattaaaaacatttcacgatttggaatttgattcctgcgatcacaggtatgacaggttagattttgttttgtatagttgtatacatacttctttgtgatgttttgtttacttaatcgaatttttggagtgttttaaggtctctcgtttagaaatcgtggaaaatatcactgtgtgtgtgttcttatgattcacagtgtttatgggtttcatgttctttgttttatcattgaatgggaagaaatttcgttgggatacaaatttctcatgttcttactgatcgttattaggagtttggggaaaaaggaagagtttttttggttggttcgagtgattatgaggttatttctgtatttgatttatgagttaatggtcgttttaatgttgtagaccgccatggctattttgaaccctgaggctgattctgctgctaacctcgctactgattctgaggctaagcaaagacaattggctgaggctggatacactcacgttgagggtgctcctgctcctttgcctttggagttgcctcacttctctctcagagatctcagagctgctattcctaagcactgcttcgagagatctttcgtgacctccacctactacatgatcaagaacgtgttgacttgcgctgctttgttctacgctgctaccttcattgatagagctggagctgctgcttatgttttgtggcctgtgtactggttcttccagggatcttacttgactggagtgtgggttatcgctcacgagtgtggacaccaggcttattgctcttctgaggtggtgaacaacttgattggactcgtgttgcactctgctttgttggtgccttaccactcttggagaatctctcacagaaagcaccactccaacactggatcttgcgagaacgatgaggttttcgttcctgtgaccagatctgtgttggcttcttcttggaacgagaccttggaggattctcctctctaccaactctaccgtatcgtgtacatgttggttgttggatggatgcctggatacctcttcttcaacgctactggacctactaagtactggggaaagtctaggtctcacttcaacccttactccgctatctatgctgatagggagaggtggatgatcgtgctctccgatattttcttggtggctatgttggctgttttggctgctttggtgcacactttctccttcaacacgatggtgaagttctacgtggtgccttacttcattgtgaacgcttacttggtgttgattacctacctccaacacaccgatacctacatccctcacttcagagagggagagtggaattggttgagaggagctttgtgcactgtggatagatcatttggtccattcctcgattctgtggtgcatagaatcgtggatacccacgtttgccaccatatcttctccaagatgcctttctatcactgcgaggaggctaccaacgctattaagcctctcctcggaaagttctacttgaaggatactactcctgttcctgttgctctctggagatcttacacccactgcaagttcgttgaggatgatggaaaggtggtgttctacaagaacaagttatagttaatgaataattgattggttcgagtattatggcattgggaaaactgtttttcttgtaccatttgttgtgcttgtaatttactgtgttttttattcggttttcgctatcgaactgtgaaatggaaatggatggagaagagttaatgaatgatatggtccttttgttcattctcaaattaatattatttgttttttctcttatttgttgtgtgttgaatttgaaattataagagatatgcaaacattttgttttgagtaaaaatgtgtcaaatcgtggcctctaatgaccgaagttaatatgaggagtaaaacacttgtagttgtaccattatgcttattcactaggcaacaaatatattttcagacctagaaaagctgcaaatgttactgaatacaagtatgtcctcttgtgttttagacatttatgaactttcctttatgtaattttccagaatccttgtcagattctaatcattgctttataattatagttatactcatggatttgtagttgagtatgaaaatattttttaatgcattttatgacttgccaattgattgacaacatgcatcaatctagctagcctcagctgacgttacgtaacgctaggtagcgtcacgtgacgttagctaacgctaggtagcgtcagctgagcttacgtaagcgccacgggcaggacatagggactactacaagcatagtatgcttcagacaaagagctaggaaagaactcttgatggaggttaagagaaaaaagtgctagaggggcatagtaatcaaacttgtcaaaaccgtcatcatgatgagggatgacataatataaaaagttgactaaggtcttggtagtactctttgattagtattatatattggtgagaacatgagtcaagaggagacaagaaaccgaggaaccatagtttagcaacaagatggaagttgcaaagttgagctagccgctcgattagttacatctcctaagcagtactacaaggaatggtctctatactttcatgtttagcacatggtagtgcggattgacaagttagaaacagtgcttaggagacaaagagtcagtaaaggtattgaaagagtgaagttgatgctcgacaggtcaggagaagtccctccgccagatggtgactaccaaggggttggtatcagctgagacccaaataagattcttcggttgaaccagtggttcgaccgagactcttagggtgggatttcactgtaagatttgtgcattttgttgaatataaattgacaattttttttatttaattatagattatttagaatgaattacatatttagtttctaacaaggatagcaatggatgggtatgggtacaggttaaacatatctattacccacccatctagtcgtcgggttttacacgtacccacccgtttacataaaccagaccggaattttaaaccgtacccgtccgttagcgggtttcagatttacccgtttaatcgggtaaaacctgattactaaatatatattttttatttgataaacaaaacaaaaatgttaatattttcatattggatgcaattttaagaaacacatattcataaatttccatatttgtaggaaaataaaaagaaaaatatattcaagaacacaaatttcaccgacatgacttttattacagagttggaattagatctaacaattgaaaaattaaaattaagatagaatatgttgaggaacatgacatagtataatgctgggttacccgtcgggtaggtatcgaggcggatactactaaatccatcccactcgctatccgataatcactggtttcgggtatacccattcccgtcaacaggcctttttaaccggataatttcaacttatagtgaatgaattttgaataaatagttagaataccaaaatcctggattgcatttgcaatcaaattttgtgaaccgttaaattttgcatgtacttgggatagatataatagaaccgaattttcattagtttaatttataacttactttgttcaaagaaaaaaaatatctatccaatttacttataataaaaaataatctatccaagttacttattataatcaacttgtaaaaaggtaagaatacaaatgtggtagcgtacgtgtgattatatgtgacgaaatgttatatctaacaaaagtccaaattcccatggtaaaaaaaatcaaaatgcatggcaggctgtttgtaaccttggaataagatgttggccaattctggagccgccacgtacgcaagactcagggccacgttctcttcatgcaaggatagtagaacaccactccacccacctcctatattagacctttgcccaaccctccccaactttcccatcccatccacaaagaaaccgacatttttatcataaatcagggtttcgtttttgtttcatcgataaactcaaaggtgatgattttagggtcttgtgagtgtgcttttttgtttgattctactgtagggtttatgttctttagctcataggttttgtgtatttcttagaaatgtggcttctttaatctctgggtttgtgactttttgtgtggtttctgtgtttttcatatcaaaaacctattttttccgagtttttttttacaaattcttactctcaagcttgaatacttcacatgcagtgttcttttgtagattttagagttaatgtgttaaaaagtttggatttttcttgcttatagagcttcttcactttgattttgtgggtttttttgttttaaaggtgagatttttgatgaggtttttgcttcaaagatgtcacctttctgggtttgtcttttgaataaagctatgaactgtcacatggctgacgcaattttgttactatgtcatgaaagctgacgtttttccgtgttatacatgtttgcttacacttgcatgcgtcaaaaaaattggggctttttagttttagtcaaagattttacttctcttttgggatttatgaaggaaagttgcaaactttctcaaattttaccatttttgctttgatgtttgtttagattgcgacagaacaaactcatatatgttgaaatttttgcttggttttgtataggattgtgtcttttgcttataaatgttgaaatctgaactttttttttgtttggtttctttgagcaggagataaggcgcaccaccatggcttctacatctgctgctcaagacgctgctccttacgagttcccttctctcactgagatcaagagggctcttccttctgagtgtttcgaggcttctgttcctctttctctctactacaccgctagatctcttgctcttgctggatctctcgctgttgctctctcttacgctagagctttgcctcttgttcaggctaacgctcttcttgatgctactctctgcactggatacgttcttctccagggaatcgttttctggggattcttcaccgttggtcacgattgtggacacggagctttctctagatctcacgtgctcaacttctctgttggaaccctcatgcactctatcatccttacccctttcgagtcttggaagctctctcacagacaccaccacaagaacaccggaaacatcgataaggacgagatcttctaccctcaaagagaggctgattctcaccctgtttctagacaccttgtgatgtctcttggatctgcttggttcgcttaccttttcgctggattccctcctagaaccatgaaccacttcaacccttgggaggctatgtatgttagaagagtggctgctgtgatcatctctctcggagttcttttcgctttcgctggactctactcttacctcaccttcgttcttggattcaccactatggctatctactacttcggacctctcttcatcttcgctaccatgcttgttgttaccactttcctccaccacaacgatgaggagacaccttggtacgctgattctgagtggacttacgtgaagggaaacctctcttctgtggacagatcttacggtgctctcatcgacaaccttagccacaacatcggaactcaccagatccaccacctcttccctatcatccctcactacaagctcaacgatgctactgctgctttcgctaaggctttccctgagcttgttaggaaaaacgctgctcctatcatcccaactttcttcaggatggctgctatgtacgctaagtacggagttgttgacactgatgctaagaccttcactctcaaggaggctaaggctgctgctaagactaagtcatcttgatgattaatgaaggccgcagatatcagatctggtcgacctagaggatccccggccgcaaagataataacaaaagcctactatataacgtacatgcaagtattgtatgatattaatgtttttacgtacgtgtaaacaaaaataattacgtttgtaacgtatggtgatgatgtggtgcactaggtgtaggccttgtattaataaaaagaagtttgttctatatagagtggtttagtacgacgatttatttactagtcggattggaatagagaaccgaattcttcaatccttgcttttgatcaagaattgaaaccgaatcaaatgtaaaagttgatatatttgaaaaacgtattgagcttatgaaaatgctaatactctcatctgtatggaaaagtgactttaaaaccgaacttaaaagtgacaaaaggggaatatcgcatcaaaccgaatgaaaccgatctacgtaggctcagctgagcttacctaaggctacgtaggctcacgtgacgttacgtaaggctacgtagcgtcacgtgagcttacctaactctagctagcctcacgtgaccttagctaacactaggtagcgtcagcacagatgaatactagctgttgttcacagttctagtgtctcctcattacgtgaattcaagctacgatcactatctcaactcctacataaacatcagaatgctacaaaactatgcacaaaaacaaaagctacatctaatacgtgaatcaattactctcatcacaagaaagaagatttcaatcaccgtcgagaaggaggattcagttaattgaatcaaagttccgatcaaactcgaagactggtgagcacgaggacgacgaagaagagtgtctcgaagatacaacaagcaagaaatctactgagtgacctcctgaagttattggcgcgattgagagaatcaatccgaattaatttcggggaaaaagataaattagatactaagcgatgggcttgggctgggctaagaaacaggtggcaattgggctggaggaccccgcgattcatagcttccgatagcccaaaaaaaaacggataacatatttatcgggtatttgaatttcagtgaaataagatattttctttttgttaggaaaattttagaaaataatggaaattaaatagcgattatgttacaagatacgatcagcatcgggcagtgcaaaatgctatagcttcccaagatttgatccttttgggttatctcctaatgacaattagtttaggattttgaaacttatattaatactattatccgacaacacttgtttcagcttcttattttaacattttttgtttttttctattcttcttcccatcagcattttctttttaaaaaattgaatactttaactttttaaaaatttcacaatgatcagatgatattatggaagatctcaagagttaaatgtatccatcttggggcattaaaaccggtgtacgggatgataaatacagactttatatcatatgatagctcagtaattcatatttatcacgttgctaaaaaaattataaggtactagtagtcaacaaaatcaattaaagagaaagaaagaaacgcatgtgaagagagtttacaactggaaaagtaaaataaaaattaacgcatgttgaatgctgacatgtcagtatgtccatgaatccacgtatcaagcgccattcatcgatcgtcttcctctttctaaatgaaaacaacttcacacatcacaacaaacaatacacacaagaccccctctctctcgttgtctctctgccagcgaccaaatcgaagcttgagaagaacaagaaggggtcaaaccatgggaaaaggatctgagggaagatctgctgctagagagatgactgctgaggctaacggagataagagaaagaccatcctcattgagggagtgttgtacgatgctaccaacttcaaacacccaggaggttccattattaacttcctcaccgagggagaagctggagttgatgctacccaagcttacagagagttccatcagagatccggaaaggctgataagtacctcaagtccctcccaaagttggatgcttctaaggtggagtctaggttctctgctaaggagcaggctagaagggacgctatgaccagggattacgctgctttcagagaggagttggttgctgagggatacttcgatccatctatcccacacatgatctacagagtggtggagattgtggctttgttcgctttgtctttctggttgatgtctaaggcttctccaacctctttggttttgggagtggtgatgaacggaatcgctcaaggaagatgcggatgggttatgcacgagatgggacacggatctttcactggagttatctggctcgatgataggatgtgcgagttcttctacggagttggatgtggaatgtctggacactactggaagaaccagcactctaagcaccacgctgctccaaacagattggagcacgatgtggatttgaacaccttgccactcgttgctttcaacgagagagttgtgaggaaggttaagccaggatctttgttggctttgtggctcagagttcaggcttatttgttcgctccagtgtcttgcttgttgatcggattgggatggaccttgtacttgcacccaagatatatgctcaggaccaagagacacatggagtttgtgtggatcttcgctagatatatcggatggttctccttgatgggagctttgggatattctcctggaacttctgtgggaatgtacctctgctctttcggacttggatgcatctacatcttcctccaattcgctgtgtctcacacccacttgccagttaccaacccagaggatcaattgcactggcttgagtacgctgctgatcacaccgtgaacatctctaccaagtcttggttggttacctggtggatgtctaacctcaacttccaaatcgagcaccacttgttcccaaccgctccacaattcaggttcaaggagatctctccaagagttgaggctctcttcaagagacacaacctcccttactacgatttgccatacacctctgctgtttctactaccttcgctaacctctactctgttggacactctgttggagctgataccaagaagcaggattgatgattaatgaataattgattgtacatactatattttttgtttaccttgtgttagtttaatgttcagtgtcctctctttattgtggcacgtctctttgttgtatgttgtgtctatacaaagttgaaataatggaaagaaaaggaagagtgtaatttgttttgttttaagtgtttataaatatatatatataggtcatttagatagttctaggtttctataaaactctctctctggaagtagaatctgtttttgagaggatccagttgcctactaatctcccccaaaacccttcaagcttaaccttcctcttcacaacaacagaggaaacacatctcttgagctctgagttctcttctttgagcatgtctatcgctaaactcatctgccttatagcttccctcttctcttcatctctctctctcaccatttcgctgtaaaacttattctcctccctcagcctctctatctcttccttcagcatctcacaattcccaccataatcgactgaggatgattcaccgtcatcaacttcagactcagcgttgtagtcgtcatgagtctcacaagccttggaccaagaagactcatcatcgcaagttgatgatttatcatgatgcttctctgagccgtgtttgctacgtagcgtcacctgacgttacgtaaggctacctaggctcacgtgacgttacgtaacgctacgtagcgtcaggtgaggttagctaacgctagctagcctcacctgacgttaggtaaggctacgtagcgtcacctgagattagctaagcctacctagactcacgtgaccttaggtaacgctacgtagcgtcaaagctttacaacgctacacaaaacttataaccgtaatcaccattcattaacttaactactatcacatgcattcatgaattgaaacgagaaggatgtaaatagttgggaagttatctccacgttgaagagatcgttagcgagagctgaaagaccgagggaggagacgccgtcaacacggacagagtcgtcgaccctcacatgaagtaggaggaatctccgtgaggagccagagagacgtctttggtcttcggtttcgatccttgatctgacggagaagacgagagaagtgcgactggactccgtgaggaccaacagagtcgtcctcggtttcgatcgtcggtattggtggagaaggcggaggaatctccgtgacgagccagagagatgtcgtcggtcttcggtttcgatccttgatctgacggagaagacgagagaagtgcgacgagactccgtgaggaccaacagagttgtcctcggtttcgatcgtcggtttcggcggagaaggcggaggaatctccgtgaggagccagagagacgtcgttggtcttcggtttcgatccttgatctgttggagaagacgagacaagtgggacgagactcaacgacggagtcagagacgtcgtcggtcttcggtttcggccgagaaggcggagtcggtcttcggtttcggccgagaaggcggaggagacgtcttcgatttgggtctctcctcttgacgaagaaaacaaagaacacgagaaataatgagaaagagaacaaaagaaaaaaaaataaaaataaaaataaaatttggtcctcttatgtggtgacacgtggtttgaaacccaccaaataatcgatcacaaaaaacctaagttaaggatcggtaataacctttctaattaattttgatttatattaaatcactctttttatttataaaccccactaaattatgcgatattgattgtctaagtacaaaaattctctcgaattcaatacacatgtttcatatatttagccctgttcatttaatattactagcgcatttttaatttaaaattttgtaaacttttttggtcaaagaacatttttttaattagagacagaaatctagactctttatttggaataatagtaataaagatatattaggcaatgagtttatgatgttatgtttatatagtttatttcattttaaattgaaaagcattatttttatcgaaatgaatctagtatacaatcaatatttatgttttttcatcagatactttcctattttttggcacctttcatcggactactgatttatttcaatgtgtatgcatgcatgagcatgagtatacacatgtcttttaaaatgcatgtaaagcgtaacggaccacaaaagaggatccatacaaatacatctcatcgcttcctctactattctccgacacacacactgagcatggtgcttaaacactctggtgagttctagtacttctgctatgatcgatctcattaccatttcttaaatttctctccctaaatattccgagttcttgatttttgataacttcaggttttctctttttgataaatctggtctttccatttttttttttttgtggttaatttagtttcctatgttcttcgattgtattatgcatgatctgtgtttggattctgttagattatgtattggtgaatatgtatgtgtttttgcatgtctggttttggtcttaaaaatgttcaaatctgatgatttgattgaagcttttttagtgttggtttgattcttctcaaaactactgttaatttactatcatgttttccaactttgattcatgatgacacttttgttctgctttgttataaaattttggttggtttgattttgtaattatagtgtaattttgttaggaatgaacatgttttaatactctgttttcgatttgtcacacattcgaattattaatcgataatttaactgaaaattcatggttctagatcttgttgtcatcagattatttgtttcgataattcatcaaatatgtagtccttttgctgatttgcgactgtttcattttttctcaaaattgttttttgttaagtttatctaacagttatcgttgtcaaaagtctctttcattttgcaaaatcttctttttttttttgtttgtaactttgttttttaagctacacatttagtctgtaaaatagcatcgaggaacagttgtcttagtagacttgcatgttcttgtaacttctatttgtttcagtttgttgatgactgctttgattttgtaggtcaaaccgcgccatgtctgctagcggagctttgttgcctgctatagctttcgctgcttacgcttacgctacctacgcttatgctttcgagtggagccacgctaacggaatcgataacgtggatgctagagagtggattggagctttgtctttgagactccctgcaattgcaaccacaatgtacctcttgttctgccttgtgggacctagattgatggctaagagggaggcttttgatcctaagggatttatgctcgcttacaacgcttaccaaaccgctttcaacgttgtggtgctcggaatgttcgctagagagatctctggattgggacaacctgtttggggatctactatgccttggagcgataggaagtccttcaagattttgttgggagtgtggctccactacaacaataagtacctcgagttgttggatactgtgttcatggtggctaggaaaaagaccaagcagctctctttcttgcacgtgtaccaccacgctttgttgatttgggcttggtggcttgtttgtcacctcatggctaccaacgattgcatcgatgcttatttcggagctgcttgcaactctttcatccacatcgtgatgtactcctactacctcatgtctgctttgggaattaggtgcccttggaagagatatatcacccaggctcagatgttgcaattcgtgatcgtgttcgctcacgctgttttcgtgctcagacaaaagcactgccctgttactttgccttgggcacaaatgttcgtgatgacaaatatgttggtgctcttcggaaacttctacctcaaggcttactctaacaagtctaggggagatggagcttcttctgttaagcctgctgagactactagagcaccttctgtgagaagaaccaggtcaaggaagatcgattgatagttaatgaactaagtttgatgtatctgagtgccaacgtttactttgtctttcctttcttttattggttatgattagatgtttactatgttctctctttttcgttataaataaagaagttcaattcttctatagtttcaaacgcgattttaagcgtttctatttaggtttacatgatttcttttacaaaatcatctttaaaatacagtatatttttagttttcataaaatatttaaagaaatgaaagtttataaacattcactcctattctctaattaaggatttgtaaaacaaaaattttgtaagcatatcgatttatgcgttttgtcttaattagctcactaaataataaataatagcttatgttgtgggactgtttaattacctaacttagaactaaaatcaactctttgtgctacctagagtcagctgagcttagctaacgctagctagtgtcagctgacgttacgtaaggctaactagcgtcacgtgaccttacgtaacgctacgtaggctcagctgagcttagctaaccctagctagtgtcacgtgagcttacgctactatagaaaatgtgttatatcgacatgaccagacaaaggggcaacagttaacaaaacaattaattctttcatttgagattaaggaaggtaaggtactaaaaagattaaaaaaaatgagcttatctctttgtttctgtaataataatataagtgtgataaacttttaatataataattgtaattaggttttctacagatgagcaccactcagagacaagataagaagaaaacaattttgttaaacatgattatagaaacttttagttaagtcttgaagtatcaatataacaaaaaaaagtacacacgactatgacaataaacccactaccgtcaggttatcatttcgatgaaatgttttgatatcattaaatataacagtcacaaaaaatcatctaattataacaatataacttatacatatatttaactaaaaacttagagtttttgtaatgattctaattgatgattagagtttatagaaatacaattaaataaaaaatataattttaaaaaaacatagtaaagtcaatgagatcctctctgacctcagtgatcatttagtcatgtatgtacaacaatcattgttcatcacatgactgtaaaataaataaggataaacttgggaatatatataatatattgtattaaataaaaaagggaaatacaaatatcaattttagattcccgagttgacacaactcaccatgcacgctgccacctcagctcccagctctcgtcacatgtctcatgtcagttaggtctttggtttttagtctttgacacaactcgccatgcatgttgccacgtgagctcgttcctcttcccatgatctcaccactgggcatgcatgctgccacctcagctggcacctcttctctatatgtccctagaggccatgcacagtgccacctcagcactcctctcagaacccatacgtacctgccaatcggcttctctccataaatatctatttaaattataactaattatttcatatacttaattgatgacgtggatgcattgccatcgttgtttaataattgttaattacgacatgataaataaaatgaaagtaaaaagtacgaaagattttccatttgttgttgtataaatagagaagtgagtgatgcataatgcatgaatgcatgaccgcgccaccatgactgttggatacgacgaggagatcccattcgagcaagttagggctcataacaagccagacgacgcttggtgtgctattcacggacacgtgtacgacgttaccaagttcgcttcagttcacccaggaggagatattatcttgctcgctgctggaaaggaagctactgtcctctacgagacctaccatgttagaggagtgtctgacgctgtgctcagaaagtacagaataggaaagttgccagacggacaaggaggagctaacgagaaggagaagagaaccttgtctggattgtcctctgcttcttactacacctggaactccgatttctacagagtgatgagggagagagttgtggctagattgaaggagagaggaaaggctagaagaggaggatacgaactctggatcaaggctttcttgctccttgttggattctggtcctctctttactggatgtgcaccctcgatccatctttcggagctatcttggctgctatgtctttgggagtgttcgctgcttttgttggaacctgcatccaacacgatggaaaccacggagctttcgctcaatctagatgggttaacaaggtggcaggatggactttggatatgatcggagcttctggaatgacttgggagttccaacacgtgttgggacaccacccatacactaacttgatcgaggaggagaacggattgcaaaaggtgtccggaaagaagatggataccaagttggctgatcaagagtctgatccagatgtgttctccacctacccaatgatgagattgcacccttggcaccagaagaggtggtatcacaggttccagcacatctacggacctttcatcttcggattcatgaccatcaacaaggtggtgactcaagatgttggagtggtgttgagaaagagactcttccaaatcgatgctgagtgcagatatgcttccccaatgtacgttgctaggttctggattatgaaggctttgaccgtgttgtatatggttgctttgccttgttatatgcaaggaccttggcacggattgaaactcttcgctatcgctcacttcacttgcggagaggttttggctaccatgttcatcgtgaaccacattatcgagggagtgtcttacgcttctaaggatgctgttaagggaactatggctccaccaaagactatgcacggagtgaccccaatgaacaacactagaaaggaggttgaggctgaggcttctaagtctggagctgtggttaagtctgtgccattggatgattgggctgctgttcagtgccaaacctctgtgaactggtctgttggatcttggttttggaaccacttctctggaggactcaaccaccaaatcgagcaccacctcttcccaggattgtctcacgagacctactaccacatccaagacgtggttcaatctacctgtgctgagtacggagttccataccaacacgagccatctttgtggactgcttactggaagatgctcgaacaccttagacaattgggaaacgaggagactcacgagtcatggcagagagctgcttgattaatgaactaagactcccaaaaccaccttccctgtgacagttaaaccctgcttatacctttcctcctaataatgttcatctgtcacacaaactaaaataaataaaatgggagcaataaataaaatgggagctcatatatttacaccatttacactgtctattattcaccatgccaattattacttcataattttaaaattatgtcatttttaaaaattgcttaatgatggaaaggattattataagttaaaagtataacatagataaactaaccacaaaacaaatcaatataaactaacttactctcccatctaatttttatttaaatttctttacacttctcttccatttctatttctacaacattatttaacatttttattgtatttttcttactttctaactctattcatttcaaaaatcaatatatgtttatcaccacctctctaaaaaaaactttacaatcattggtccagaaaagttaaatcacgagatggtcattttagcattaaaacaacgattcttgtatcactatttttcagcatgtagtccattctcttcaaacaaagacagcggctatataatcgttgtgttatattcagtctaaaacaactacgtagcgtcacgtgacgttacctaagcctaggtagcctcagctgacgttacgtaacgctaggtaggctcagctgactgcagcaaatttacacattgccactaaacgtctaaacccttgtaatttgtttttgttttactatgtgtgttatgtatttgatttgcgataaatttttatatttggtactaaatttataacaccttttatgctaacgtttgccaacacttagcaatttgcaagttgattaattgattctaaattatttttgtcttctaaatacatatactaatcaactggaaatgtaaatatttgctaatatttctactataggagaattaaagtgagtgaatatggtaccacaaggtttggagatttaattgttgcaatgctgcatggatggcatatacaccaaacattcaataattcttgaggataataatggtaccacacaagatttgaggtgcatgaacgtcacgtggacaaaaggtttagtaatttttcaagacaacaatgttaccacacacaagttttgaggtgcatgcatggatgccctgtggaaagtttaaaaatattttggaaatgatttgcatggaagccatgtgtaaaaccatgacatccacttggaggatgcaataatgaagaaaactacaaatttacatgcaactagttatgcatgtagtctatataatgaggattttgcaatactttcattcatacacactcactaagttttacacgattataatttcttcatagccagtactgtttaagcttcactgtctctgaatcggcaaaggtaaacgtatcaattattctacaaacccttttatttttcttttgaattaccgtcttcattggttatatgataacttgataagtaaagcttcaataattgaatttgatctgtgtttttttggccttaatactaaatccttacataagctttgttgcttctcctcttgtgagttgagtgttaagttgtaataatggttcactttcagctttagaagaaacgcgccttccatggctacaaaggaggcttacgttttcccaactctcaccgagatcaagagatctctcccaaaggattgcttcgaggcttctgtgcctttgtctctctactacactgtgagatgcttggttattgctgtggctttgaccttcggattgaactacgctagagctttgccagaggttgagtctttctgggctttggatgctgctttgtgcactggatatatcctcctccagggaattgtgttctggggattcttcactgttggacacgatgctggacacggagctttctctagataccacctcttgaacttcgttgtgggaaccttcatgcactctctcatcttgaccccattcgagtcttggaagttgacccacagacaccaccacaagaacaccggaaacatcgatagagatgaggtgttctacccacagagaaaggctgatgatcacccattgtccaggaacttgatcttggctttgggagctgcttggcttgcttatttggtggagggattcccaccaagaaaggtgaaccacttcaacccattcgagccactttttgtgagacaagtgtccgctgtggttatctctttgctcgctcacttcttcgttgctggactctctatctacttgtctctccagttgggacttaagaccatggctatctactactacggaccagttttcgtgttcggatctatgttggtgattaccaccttcttgcaccacaacgatgaggagactccatggtatgctgattctgagtggacttacgtgaagggaaacttgtcctctgtggatagatcttacggtgctctcatcgataacctctcccacaacatcggaactcaccagatccaccacctcttcccaattatcccacactacaagctcaagaaggctactgctgctttccaccaagctttcccagagcttgtgagaaagtccgatgagccaatcatcaaggctttcttcagagtgggaaggttgtatgctaactacggagtggttgatcaagaggctaagctcttcactttgaaggaggctaaggctgctactgaagctgctgctaagaccaagtctacctgattaatgaatcgacaagctcgagtttctccataataatgtgtgagtagttcccagataagggaattagggttcctatagggtttcgctcatgtgttgagcatataagaaacccttagtatgtatttgtatttgtaaaatacttctatcaataaaatttctaattcctaaaaccaaaatccagtactaaaatccagatcccccgaattaattcggcgttaattcagctacgtagcgtcacctgacgttacgtaaggctacctaggctcacgtgacgttacgtaacgctacgtagcgtcaggtgaggttagctaacgctagctagcctcacctgacgttaggtaaggctacgtagcgtcacctgagattagctaagcctacctagactcacgtgaccttaggtaacgctacgtagcgtcaaagctttacaacgctacacaaaacttataaccgtaatcaccattcattaacttaactactatcacatgcattcatgaattgaaacgagaaggatgtaaatagttgggaagttatctccacgttgaagagatcgttagcgagagctgaaagaccgagggaggagacgccgtcaacacggacagagtcgtcgaccctcacatgaagtaggaggaatctccgtgaggagccagagagacgtctttggtcttcggtttcgatccttgatctgacggagaagacgagagaagtgcgactggactccgtgaggaccaacagagtcgtcctcggtttcgatcgtcggtattggtggagaaggcggaggaatctccgtgacgagccagagagatgtcgtcggtcttcggtttcgatccttgatctgacggagaagacgagagaagtgcgacgagactccgtgaggaccaacagagttgtcctcggtttcgatcgtcggtttcggcggagaaggcggaggaatctccgtgaggagccagagagacgtcgttggtcttcggtttcgatccttgatctgttggagaagacgagacaagtgggacgagactcaacgacggagtcagagacgtcgtcggtcttcggtttcggccgagaaggcggagtcggtcttcggtttcggccgagaaggcggaggagacgtcttcgatttgggtctctcctcttgacgaagaaaacaaagaacacgagaaataatgagaaagagaacaaaagaaaaaaaaataaaaataaaaataaaatttggtcctcttatgtggtgacacgtggtttgaaacccaccaaataatcgatcacaaaaaacctaagttaaggatcggtaataacctttctaattaattttgatttatattaaatcactctttttatttataaaccccactaaattatgcgatattgattgtctaagtacaaaaattctctcgaattcaatacacatgtttcatatatttagccctgttcatttaatattactagcgcatttttaatttaaaattttgtaaacttttttggtcaaagaacatttttttaattagagacagaaatctagactctttatttggaataatagtaataaagatatattaggcaatgagtttatgatgttatgtttatatagtttatttcattttaaattgaaaagcattatttttatcgaaatgaatctagtatacaatcaatatttatgttttttcatcagatactttcctattttttggcacctttcatcggactactgatttatttcaatgtgtatgcatgcatgagcatgagtatacacatgtcttttaaaatgcatgtaaagcgtaacggaccacaaaagaggatccatacaaatacatctcatcgcttcctctactattctccgacacacacactgagcatggtgcttaaacactctggtgagttctagtacttctgctatgatcgatctcattaccatttcttaaatttctctccctaaatattccgagttcttgatttttgataacttcaggttttctctttttgataaatctggtctttccatttttttttttttgtggttaatttagtttcctatgttcttcgattgtattatgcatgatctgtgtttggattctgttagattatgtattggtgaatatgtatgtgtttttgcatgtctggttttggtcttaaaaatgttcaaatctgatgatttgattgaagcttttttagtgttggtttgattcttctcaaaactactgttaatttactatcatgttttccaactttgattcatgatgacacttttgttctgctttgttataaaattttggttggtttgattttgtaattatagtgtaattttgttaggaatgaacatgttttaatactctgttttcgatttgtcacacattcgaattattaatcgataatttaactgaaaattcatggttctagatcttgttgtcatcagattatttgtttcgataattcatcaaatatgtagtccttttgctgatttgcgactgtttcattttttctcaaaattgttttttgttaagtttatctaacagttatcgttgtcaaaagtctctttcattttgcaaaatcttctttttttttttgtttgtaactttgttttttaagctacacatttagtctgtaaaatagcatcgaggaacagttgtcttagtagacttgcatgttcttgtaacttctatttgtttcagtttgttgatgactgctttgattttgtaggtcaaaccgcgccatgccacctagtgctgctagtgaaggtggtgttgctgaacttagagctgctgaagttgctagctacactagaaaggctgttgacgaaagacctgacctcactatagttggtgacgctgtttacgacgctaaggcttttagggacgagcaccctggtggtgctcacttcgttagccttttcggaggtagggacgctactgaggcttttatggaatatcaccgtagagcttggcctaaggctaggatgtctaagttcttcgttggttcacttgacgctagcgagaagcctactcaagctgattcagcttaccttagactttgcgctgaggttaacgctcttttgcctaagggtagcggaggattcgctcctcctagctactggcttaaggctgctgctcttgttgttgctgctgttagtatagagggttatatgctccttaggggtaagacccttttgcttagcgttttccttggactcgtgttcgcttggataggacttaatattcagcacgacgctaatcacggtgctcttagtagacactcagtgattaactactgcctcggttacgctcaggattggataggtggtaatatggtgctttggcttcaagagcacgttgtgatgcaccacctccacactaacgacgttgacgctgatcctgatcaaaaggctcacggtgttcttagacttaagcctactgacggttggatgccttggcacgcacttcaacaactctatatccttcctggtgaggctatgtacgcttttaagcttcttttcttggacgcccttgagcttcttgcttggaggtgggagggtgagaagattagccctcttgctagagctttgttcgctcctgctgttgcttgtaagcttggattctgggctagattcgttgctctccctctctggcttcaacctactgttcacactgctttgtgtatctgtgctactgtgtgtactggtagcttctacctcgccttcttcttctttatctctcacaacttcgacggtgttggtagcgttggacctaagggatcacttcctagatcagctactttcgttcaacgtcaggttgagactagctctaacgttggtggttactggcttggagttcttaacggtggacttaactttcagatagagcaccacttgttccctaggcttcaccactcttactacgctcaaatagctcctgtggttaggactcacatagagaagctcggttttaagtaccgtcacttccctaccgttggatctaaccttagctcaatgcttcagcatatgggtaagatgggaactagacctggtgctgagaagggtggtaaggctgagtagtagttaatgaactaagtttgatgtatctgagtgccaacgtttactttgtctttcctttcttttattggttatgattagatgtttactatgttctctctttttcgttataaataaagaagttcaattcttctatagtttcaaacgcgattttaagcgtttctatttaggtttacatgatttcttttacaaaatcatctttaaaatacagtatatttttagttttcataaaatatttaaagaaatgaaagtttataaacattcactcctattctctaattaaggatttgtaaaacaaaaattttgtaagcatatcgatttatgcgttttgtcttaattagctcactaaataataaataatagcttatgttgtgggactgtttaattacctaacttagaactaaaatcaactctttgtgctagctagcctcagctgacgttacgtaacgctaggtagcgtcacgtgacgttagctaacgctaggtagcgtcagctgagcttacgtaagcgcacagatgaatactagctgttgttcacagttctagtgtctcctcattacgtgaattcaagctacgatcactatctcaactcctacataaacatcagaatgctacaaaactatgcacaaaaacaaaagctacatctaatacgtgaatcaattactctcatcacaagaaagaagatttcaatcaccgtcgagaaggaggattcagttaattgaatcaaagttccgatcaaactcgaagactggtgagcacgaggacgacgaagaagagtgtctcgaagatacaacaagcaagaaatctactgagtgacctcctgaagttattggcgcgattgagagaatcaatccgaattaatttcggggaaaaagataaattagatactaagcgatgggcttgggctgggctaagaaacaggtggcaattgggctggaggaccccgcgattcatagcttccgatagcccaaaaaaaaacggataacatatttatcgggtatttgaatttcagtgaaataagatattttctttttgttaggaaaattttagaaaataatggaaattaaatagcgattatgttacaagatacgatcagcatcgggcagtgcaaaatgctatagcttcccaagatttgatccttttgggttatctcctaatgacaattagtttaggattttgaaacttatattaatactattatccgacaacacttgtttcagcttcttattttaacattttttgtttttttctattcttcttcccatcagcattttctttttaaaaaattgaatactttaactttttaaaaatttcacaatgatcagatgatattatggaagatctcaagagttaaatgtatccatcttggggcattaaaaccggtgtacgggatgataaatacagactttatatcatatgatagctcagtaattcatatttatcacgttgctaaaaaaattataaggtactagtagtcaacaaaatcaattaaagagaaagaaagaaacgcatgtgaagagagtttacaactggaaaagtaaaataaaaattaacgcatgttgaatgctgacatgtcagtatgtccatgaatccacgtatcaagcgccattcatcgatcgtcttcctctttctaaatgaaaacaacttcacacatcacaacaaacaatacacacaagaccccctctctctcgttgtctctctgccagcgaccaaatcgaagcttgagaagaacaagaaggggtcaaaccatggcttctacatctgctgctcaagacgctgctccttacgagttcccttctctcactgagatcaagagggctcttccttctgagtgtttcgaggcttctgttcctctttctctctactacaccgctagatctcttgctcttgctggatctctcgctgttgctctctcttacgctagagctttgcctcttgttcaggctaacgctcttcttgatgctactctctgcactggatacgttcttctccagggaatcgttttctggggattcttcaccgttggtcacgattgtggacacggagctttctctagatctcacgtgctcaacttctctgttggaaccctcatgcactctatcatccttacccctttcgagtcttggaagctctctcacagacaccaccacaagaacaccggaaacatcgataaggacgagatcttctaccctcaaagagaggctgattctcaccctgtttctagacaccttgtgatgtctcttggatctgcttggttcgcttaccttttcgctggattccctcctagaaccatgaaccacttcaacccttgggaggctatgtatgttagaagagtggctgctgtgatcatctctctcggagttcttttcgctttcgctggactctactcttacctcaccttcgttcttggattcaccactatggctatctactacttcggacctctcttcatcttcgctaccatgcttgttgttaccactttcctccaccacaacgatgaggagacaccttggtacgctgattctgagtggacttacgtgaagggaaacctctcttctgtggacagatcttacggtgctctcatcgacaaccttagccacaacatcggaactcaccagatccaccacctcttccctatcatccctcactacaagctcaacgatgctactgctgctttcgctaaggctttccctgagcttgttaggaaaaacgctgctcctatcatcccaactttcttcaggatggctgctatgtacgctaagtacggagttgttgacactgatgctaagaccttcactctcaaggaggctaaggctgctgctaagactaagtcatcttgatgattaatgaataattgattgtacatactatattttttgtttaccttgtgttagtttaatgttcagtgtcctctctttattgtggcacgtctctttgttgtatgttgtgtctatacaaagttgaaataatggaaagaaaaggaagagtgtaatttgttttgttttaagtgtttataaatatatatatataggtcatttagatagttctaggtttctataaaactctctctctggaagtagaatctgtttttgagaggatccagttgcctactaatctcccccaaaacccttcaagcttaaccttcctcttcacaacaacagaggaaacacatctcttgagctctgagttctcttctttgagcatgtctatcgctaaactcatctgccttatagcttccctcttctcttcatctctctctctcaccatttcgctgtaaaacttattctcctccctcagcctctctatctcttccttcagcatctcacaattcccaccataatcgactgaggatgattcaccgtcatcaacttcagactcagcgttgtagtcgtcatgagtctcacaagccttggaccaagaagactcatcatcgcaagttgatgatttatcatgatgcttctctgagccgtgtttgctagctagcctcagctgacgttacgtaacgctaggtagcgtcacgtgacgttagctaacgctaggtagcgtcagctgagcttacgtaagcgcttaattaaagtactgatatcggtaccaaatcgaatccaaaaattacggatatgaatataggcatatccgtatccgaattatccgtttgacagctagcaacgattgtacaattgcttctttaaaaaaggaagaaagaaagaaagaaaagaatcaacatcagcgttaacaaacggccccgttacggcccaaacggtcatatagagtaacggcgttaagcgttgaaagactcctatcgaaatacgtaaccgcaaacgtgtcatagtcagatcccctcttccttcaccgcctcaaacacaaaaataatcttctacagcctatatatacaacccccccttctatctctcctttctcacaattcatcatctttctttctctacccccaattttaagaaatcctctcttctcctcttcattttcaaggtaaatctctctctctctctctctctctgttattccttgttttaattaggtatgtattattgctagtttgttaatctgcttatcttatgtatgccttatgtgaatatctttatcttgttcatctcatccgtttagaagctataaatttgttgatttgactgtgtatctacacgtggttatgtttatatctaatcagatatgaatttcttcatattgttgcgtttgtgtgtaccaatccgaaatcgttgatttttttcatttaatcgtgtagctaattgtacgtatacatatggatctacgtatcaattgttcatctgtttgtgtttgtatgtatacagatctgaaaacatcacttctctcatctgattgtgttgttacatacatagatatagatctgttatatcattttttttattaattgtgtatatatatatgtgcatagatctggattacatgattgtgattatttacatgattttgttatttacgtatgtatatatgtagatctggactttttggagttgttgacttgattgtatttgtgtgtgtatatgtgtgttctgatcttgatatgttatgtatgtgcagctgaaccatggcggcggcaacaacaacaacaacaacatcttcttcgatctccttctccaccaaaccatctccttcctcctccaaatcaccattaccaatctccagattctccctcccattctccctaaaccccaacaaatcatcctcctcctcccgccgccgcggtatcaaatccagctctccctcctccatctccgccgtgctcaacacaaccaccaatgtcacaaccactccctctccaaccaaacctaccaaacccgaaacattcatctcccgattcgctccagatcaaccccgcaaaggcgctgatatcctcgtcgaggctttagaacgtcaaggcgtagaaaccgtattcgcttaccctggaggtacatcaatggagattcaccaagccttaacccgctcttcctcaatccgtaacgtccttcctcgtcacgaacaaggaggtgtattcgcagcagaaggatacgctcgatcctcaggtaaaccaggtatctgtatagccacttcaggtcccggagctacaaatctcgttagcggattagccgatgcgttgttagatagtgttcctcttgtagcaatcacaggacaagtccctcgtcgtatgattggtacagatgcgtttcaagagactccgattgttgaggtaacgcgttcgattacgaagcataactatcttgtgatggatgttgaagatatcccaaggattattgaagaggctttctttttagctacttctggtagacctggacctgttttggttgatgttcctaaagatattcaacaacagcttgcgattcctaattgggaacaggctatgagattacctggttatatgtctaggatgcctaaacctccggaagattctcatttggagcagattgttaggttgatttctgagtctaagaagcctgtgttgtatgttggtggtggttgtcttaattctagcgatgaattgggtaggtttgttgagcttacgggcatccctgttgcgagtacgttgatggggctgggatcttatccttgtgatgatgagttgtcgttacatatgcttggaatgcatgggactgtgtatgcaaattacgctgtggagcatagtgatttgttgttggcgtttggggtaaggtttgatgatcgtgtcacgggtaaacttgaggcttttgctagtagggctaagattgttcatattgatattgactcggctgagattgggaagaataagactcctcatgtgtctgtgtgtggtgatgttaagctggctttgcaagggatgaataaggttcttgagaaccgagcggaggagcttaaacttgattttggagtttggaggaatgagttgaacgtacagaaacagaagtttccgttgagctttaagacgtttggggaagctattcctccacagtatgcgattaaggtccttgatgagttgactgatggaaaagccataataagtactggtgtcgggcaacatcaaatgtgggcggcgcagttctacaattacaagaaaccaaggcagtggctatcatcaggaggccttggagctatgggatttggacttcctgctgcgattggagcgtctgttgctaaccctgatgcgatagttgtggatattgacggagatggaagttttataatgaatgtgcaagagctagccactattcgtgtagagaatcttccagtgaaggtacttttattaaacaaccagcatcttggcatggttatgcaatgggaagatcggttctacaaagctaaccgagctcacacatttctcggggacccggctcaggaggacgagatattcccgaacatgttgctgtttgcagcagcttgcgggattccagcggcgagggtgacaaagaaagcagatctccgagaagctattcagacaatgctggatacaccaggaccttacctgttggatgtgatttgtccgcaccaagaacatgtgttgccgatgatcccgaatggtggcactttcaacgatgtcataacggaaggagatggccggattaaatactgagagatgaaaccggtgattatcagaaccttttatggtctttgtatgcatatggtaaaaaaacttagtttgcaatttcctgtttgttttggtaatttgagtttcttttagttgttgatctgcctgctttttggtttacgtcagactactactgctgttgttgtttggtttcctttctttcattttataaataaataatccggttcggtttactccttgtgactggctcagtttggttattgcgaaatgcgaatggtaaattgagtaattgaaattcgttattagggttctaagctgttttaacagtcactgggttaatatctctcgaatcttgcatggaaaatgctcttaccattggtttttaattgaaatgtgctcatatgggccgtggtttccaaattaaataaaactacgatgtcatcgagaagtaaaatcaactgtgtccacattatcagttttgtgtatacgatgaaatagggtaattcaaaatctagcttgatatgccttttggttcattttaaccttctgtaaacattttttcagattttgaacaagtaaatccaaaaaaaaaaaaaaaaatctcaactcaacactaaattattttaatgtataaaagatgcttaaaacatttggcttaaaagaaagaagctaaaaacatagagaactcttgtaaattgaagtatgaaaatatactgaattgggtattatatgaatttttctgatttaggattcacatgatccaaaaaggaaatccagaagcactaatcagacattggaagtaggattaatcagtgatcagtaactattaaattcaattaaccgcggacatctacatttttgaattgaaaaaaaattggtaattactctttctttttctccatattgaccatcatactcattgctgatccatgtagatttcccggacatgaagccatttacaattgaatatatcctgccgccgctgccgctttgcacccggtggagcttgcatgttggtttctacgcagaactgagccggttaggcagataatttccattgagaactgagccatgtgcaccttccccccaacacggtgagcgacggggcaacggagtgatccacatgggacttttaaacatcatccgtcggatggcgttgcgagagaagcagtcgatccgtgagatcagtcgaccaattctcatgtttgacagcttatcatcgaatttctgccattcatccgcttattatcacttattcaggcgtagcaaccaggcgtttaagggcaccaataactgccttaaaaaaattacgccccgccctgccactcatcgcagtactgttgtaattcattaagcattctgccgacatggaagccatcacaaacggcatgatgaacctgaatcgccagcggcatcagcaccttgtcgccttgcgtataatatttgcccatggtgaaaacgggggcgaagaagttgtccatattggccacgtttaaatcaaaactggtgaaactcacccagggattggctgagacgaaaaacatattctcaataaaccctttagggaaataggccaggttttcaccgtaacacgccacatcttgcgaatatatgtgtagaaactgccggaaatcgtcgtggtattcactccagagcgatgaaaacgtttcagtttgctcatggaaaacggtgtaacaagggtgaacactatcccatatcaccagctcaccgtctttcattgccatacggaattccggatgagcattcatcaggcgggcaagaatgtgaataaaggccggataaaacttgtgcttatttttctttacggtctttaaaaaggccgtaatatccaggacctgcaggggggggggggcgctgaggtctgcctcgtgaagaaggtgttgctgactcataccaggcctgaatcgccccatcatccagccagaaagtgagggagccacggttgatgagagctttgttgtaggtggaccagttggtgattttgaacttttgctttgccacggaacggtctgcgttgtcgggaagatgcgtgatctgatccttcaactcagcaaaagttcgatttattcaacaaagccgccgtcccgtcaagtcagcgtaatgctctgccagtgttacaaccaattaaccaattctgattagaaaaactcatcgagcatcaaatgaaactgcaatttattcatatcaggattatcaataccatatttttgaaaaagccgtttctgtaatgaaggagaaaactcaccgaggcagttccataggatggcaagatcctggtatcggtctgcgattccgactcgtccaacatcaatacaacctattaatttcccctcgtcaaaaataaggttatcaagtgagaaatcaccatgagtgacgactgaatccggtgagaatggcaaaagcttatgcatttctttccagacttgttcaacaggccagccattacgctcgtcatcaaaatcactcgcatcaaccaaaccgttattcattcgtgattgcgcctgagcgagacgaaatacgcgatcgctgttaaaaggacaattacaaacaggaatcgaatgcaaccggcgcaggaacactgccagcgcatcaacaatattttcacctgaatcaggatattcttctaatacctggaatgctgttttcccggggatcgcagtggtgagtaaccatgcatcatcaggagtacggataaaatgcttgatggtcggaagaggcataaattccgtcagccagtttagtctgaccatctcatctgtaacatcattggcaacgctacctttgccatgtttcagaaacaactctggcgcatcgggcttcccatacaatcgatagattgtcgcacctgattgcccgacattatcgcgagcccatttatacccatataaatcagcatccatgttggaatttaatcgcggcctcgagcaagacgtttcccgttgaatatggctcataacaccccttgtattactgtttatgtaagcagacagttttattgttcatgatgatatatttttatcttgtgcaatgtaacatcagagattttgagacacaacgtggctttcccccccccccctgcaggtcctgaacggtctggttataggtacattgagcaactgactgaaatgcctcaaaatgttctttacgatgccattgggatatatcaacggtggtatatccagtgatttttttctccattttagcttccttagctcctgaaaatctcgataactcaaaaaatacgcccggtagtgatcttatttcattatggtgaaagttggaacctcttacgtgccgatcaacgtctcattttcgccaaaagttggcccagggcttcccggtatcaacagggacaccaggatttatttattctgcgaagtgatcttccgtcacaggtatttattcgcgataagctcatggagcggcgtaaccgtcgcacaggaaggacagagaaagcgcggatctgggaagtgacggacagaacggtcaggacctggattggggaggcggttgccgccgctgctgctgacggtgtgacgttctctgttccggtcacaccacatacgttccgccattcctatgcgatgcacatgctgtatgccggtataccgctgaaagttctgcaaagcctgatgggacataagtccatcagttcaacggaagtctacacgaaggtttttgcgctggatgtggctgcccggcaccgggtgcagtttgcgatgccggagtctgatgcggttgcgatgctgaaacaattatcctgagaataaatgccttggcctttatatggaaatgtggaactgagtggatatgctgtttttgtctgttaaacagagaagctggctgttatccactgagaagcgaacgaaacagtcgggaaaatctcccattatcgtagagatccgcattattaatctcaggagcctgtgtagcgtttataggaagtagtgttctgtcatgatgcctgcaagcggtaacgaaaacgatttgaatatgccttcaggaacaatagaaatcttcgtgcggtgttacgttgaagtggagcggattatgtcagcaatggacagaacaacctaatgaacacagaaccatgatgtggtctgtccttttacagccagtagtgctcgccgcagtcgagcgacagggcgaagccctcgagtgagcgaggaagcaccagggaacagcacttatatattctgcttacacacgatgcctgaaaaaacttcccttggggttatccacttatccacggggatatttttataattattttttttatagtttttagatcttcttttttagagcgccttgtaggcctttatccatgctggttctagagaaggtgttgtgacaaattgccctttcagtgtgacaaatcaccctcaaatgacagtcctgtctgtgacaaattgcccttaaccctgtgacaaattgccctcagaagaagctgttttttcacaaagttatccctgcttattgactcttttttatttagtgtgacaatctaaaaacttgtcacacttcacatggatctgtcatggcggaaacagcggttatcaatcacaagaaacgtaaaaatagcccgcgaatcgtccagtcaaacgacctcactgaggcggcatatagtctctcccgggatcaaaaacgtatgctgtatctgttcgttgaccagatcagaaaatctgatggcaccctacaggaacatgacggtatctgcgagatccatgttgctaaatatgctgaaatattcggattgacctctgcggaagccagtaaggatatacggcaggcattgaagagtttcgcggggaaggaagtggttttttatcgccctgaagaggatgccggcgatgaaaaaggctatgaatcttttccttggtttatcaaacgtgcgcacagtccatccagagggctttacagtgtacatatcaacccatatctcattcccttctttatcgggttacagaaccggtttacgcagtttcggcttagtgaaacaaaagaaatcaccaatccgtatgccatgcgtttatacgaatccctgtgtcagtatcgtaagccggatggctcaggcatcgtctctctgaaaatcgactggatcatagagcgttaccagctgcctcaaagttaccagcgtatgcctgacttccgccgccgcttcctgcaggtctgtgttaatgagatcaacagcagaactccaatgcgcctctcatacattgagaaaaagaaaggccgccagacgactcatatcgtattttccttccgcgatatcacttccatgacgacaggatagtctgagggttatctgtcacagatttgagggtggttcgtcacatttgttctgacctactgagggtaatttgtcacagttttgctgtttccttcagcctgcatggattttctcatactttttgaactgtaatttttaaggaagccaaatttgagggcagtttgtcacagttgatttccttctctttcccttcgtcatgtgacctgatatcgggggttagttcgtcatcattgatgagggttgattatcacagtttattactctgaattggctatccgcgtgtgtacctctacctggagtttttcccacggtggatatttcttcttgcgctgagcgtaagagctatctgacagaacagttcttctttgcttcctcgccagttcgctcgctatgctcggttacacggctgcggcgagcgctagtgataataagtgactgaggtatgtgctcttcttatctccttttgtagtgttgctcttattttaaacaactttgcggttttttgatgactttgcgattttgttgttgctttgcagtaaattgcaagatttaataaaaaaacgcaaagcaatgattaaaggatgttcagaatgaaactcatggaaacacttaaccagtgcataaacgctggtcatgaaatgacgaaggctatcgccattgcacagtttaatgatgacagcccggaagcgaggaaaataacccggcgctggagaataggtgaagcagcggatttagttggggtttcttctcaggctatcagagatgccgagaaagcagggcgactaccgcacccggatatggaaattcgaggacgggttgagcaacgtgttggttatacaattgaacaaattaatcatatgcgtgatgtgtttggtacgcgattgcgacgtgctgaagacgtatttccaccggtgatcggggttgctgcccataaaggtggcgtttacaaaacctcagtttctgttcatcttgctcaggatctggctctgaaggggctacgtgttttgctcgtggaaggtaacgacccccagggaacagcctcaatgtatcacggatgggtaccagatcttcatattcatgcagaagacactctcctgcctttctatcttggggaaaaggacgatgtcacttatgcaataaagcccacttgctggccggggcttgacattattccttcctgtctggctctgcaccgtattgaaactgagttaatgggcaaatttgatgaaggtaaactgcccaccgatccacacctgatgctccgactggccattgaaactgttgctcatgactatgatgtcatagttattgacagcgcgcctaacctgggtatcggcacgattaatgtcgtatgtgctgctgatgtgctgattgttcccacgcctgctgagttgtttgactacacctccgcactgcagtttttcgatatgcttcgtgatctgctcaagaacgttgatcttaaagggttcgagcctgatgtacgtattttgcttaccaaatacagcaatagtaatggctctcagtccccgtggatggaggagcaaattcgggatgcctggggaagcatggttctaaaaaatgttgtacgtgaaacggatgaagttggtaaaggtcagatccggatgagaactgtttttgaacaggccattgatcaacgctcttcaactggtgcctggagaaatgctctttctatttgggaacctgtctgcaatgaaattttcgatcgtctgattaaaccacgctgggagattagataatgaagcgtgcgcctgttattccaaaacatacgctcaatactcaaccggttgaagatacttcgttatcgacaccagctgccccgatggtggattcgttaattgcgcgcgtaggagtaatggctcgcggtaatgccattactttgcctgtatgtggtcgggatgtgaagtttactcttgaagtgctccggggtgatagtgttgagaagacctctcgggtatggtcaggtaatgaacgtgaccaggagctgcttactgaggacgcactggatgatctcatcccttcttttctactgactggtcaacagacaccggcgttcggtcgaagagtatctggtgtcatagaaattgccgatgggagtcgccgtcgtaaagctgctgcacttaccgaaagtgattatcgtgttctggttggcgagctggatgatgagcagatggctgcattatccagattgggtaacgattatcgcccaacaagtgcttatgaacgtggtcagcgttatgcaagccgattgcagaatgaatttgctggaaatatttctgcgctggctgatgcggaaaatatttcacgtaagattattacccgctgtatcaacaccgccaaattgcctaaatcagttgttgctcttttttctcaccccggtgaactatctgcccggtcaggtgatgcacttcaaaaagcctttacagataaagaggaattacttaagcagcaggcatctaaccttcatgagcagaaaaaagctggggtgatatttgaagctgaagaagttatcactcttttaacttctgtgcttaaaacgtcatctgcatcaagaactagtttaagctcacgacatcagtttgctcctggagcgacagtattgtataagggcgataaaatggtgcttaacctggacaggtctcgtgttccaactgagtgtatagagaaaattgaggccattcttaaggaacttgaaaagccagcaccctgatgcgaccacgttttagtctacgtttatctgtctttacttaatgtcctttgttacaggccagaaagcataactggcctgaatattctctctgggcccactgttccacttgtatcgtcggtctgataatcagactgggaccacggtcccactcgtatcgtcggtctgattattagtctgggaccacggtcccactcgtatcgtcggtctgattattagtctgggaccacggtcccactcgtatcgtcggtctgataatcagactgggaccacggtcccactcgtatcgtcggtctgattattagtctgggaccatggtcccactcgtatcgtcggtctgattattagtctgggaccacggtcccactcgtatcgtcggtctgattattagtctggaaccacggtcccactcgtatcgtcggtctgattattagtctgggaccacggtcccactcgtatcgtcggtctgattattagtctgggaccacgatcccactcgtgttgtcggtctgattatcggtctgggaccacggtcccacttgtattgtcgatcagactatcagcgtgagactacgattccatcaatgcctgtcaagggcaagtattgacatgtcgtcgtaacctgtagaacggagtaacctcggtgtgcggttgtatgcctgctgtggattgctgctgtgtcctgcttatccacaacattttgcgcacggttatgtggacaaaatacctggttacccaggccgtgccggcacgtttcctacaaggtagaatccgcctgagtcgcaagggtgacttcgcctatattggacgacggcgcgcagagggcgacctctttttgggttacgattgtaggattatcactaaaacaatacatgaacatattcaaatggcaatctctctaaggcattggaaataaatacaaataacagttgggtggagtttttcgacctgagggcgttaactcttcaaggacaacaagaccgtggacgtcgagcggctctccgacaagcatgtcgcccgcctggtcaagcagaccgcactcgccgccggcgcttcgataccgttcgtattggtccggcgaaactgtgagtatccgcatcgtaatctccgcatgaacaggtcatgcgaacagaaatcatctcacggtgcgtttgcctacgtgcagatttgcacctcaggtgattctaccgagtcggtgttccaaggcgcgaaatgcgagcgggtgaggccgaccagacgccgacaaggttgtgcagatctgcacttggtgccacgtcgcacagaagaagggaatcggtctaactcacagatagcatttgaagaatcgggatttagtgtgatttcgattgaaacgcgcgtaaccgttcattaaccaaaaacgtcttgcaacctcacccgcattaggtaatcgtcacggataaatggcaatacgcgccaattaaccgtgacaagagataacaccgtgagcaaagccgctgccatatcccgaaatgatcgcccgtcggtagatgttaccattggtgagcatgctgagcagctcagctctcagcttcaagcgatgagcgaggctttgtttcctccgacgtcgcacaagagcttgcgcaaattcacctcgggtgaagccgcacgcttgatgaaaatatctgactcaactcttcgaaagatgacactggctggcgaagggccgcaacctgaactcgccagcaacggacggcgcttttacaccctcggtcagataaacgaaatccggcagatgcttgccggctcgactcgaggacgtgaaagcattgattttgtgcctcatcgccgaggttctgagcatttgcaagtcgttgctgtaaccaacttcaaaggtggctctgggaagacgacgacgtccgctcatcttgcacagtatctggcgttgcaaggttacagggttctcgcagtcgatctcgatccgcaggctagtctttcagcactcctcggcgttctgccagaaactgatgtcggtgcaaacgaaacgctctatgcggctattcggtacgacgacacacgtcgtccgttgcgagatgtgatccgaccgacgtattttgatggtcttcaccttgttcctggaaatctcgagcttatggagttcgagcataccaccccgaaagcattgactgacaaaggtacgcgcgacggattgttcttcactcgcgtggcccaagcctttgatgaggtcgccgacgattacgatgtcgtggtcatcgactgccctcctcagcttgggtttttgactctcagcgggttgtgtgctgcaacatcaatggtaatcaccgtacatcctcagatgctggatatcgcttccatgagccagtttctcctcatgacacgcgaccttctgggtgtcgtgaaagaggcggggggcaatctccagtacgatttcatacgctatctcttgacgcgctatgagccccaggacgcgccgcagacgaaagtgacggcactgctgcgcaacatgttcgaggatcacgtccttacaaatcctatggtcaagtcggcagcggtatctgatgccggtttaaccaagcagacgctctatgagatagggcgagagaaccttacgcgatcgacatacgaccgggcgatggaatctttagatgcggtgaattcggagatcgaggctttgatcaagatggcgtgggggcgggtctaatgaaaggctttgcgttcctcacagatctgttgggagctcccaacagacaggtgttgattcgccccctggacatggggcactggagaagccggggtaatttgagacgacgacgcacgcccatcgctaattggccagggtgcagttgtcttgtcttgttgggagctcccaaccaagcgcatttgcaatcaaaaatgcgacgccacgacgccaaacccaagaggccgatatcatgagccgcaaagacgcaatcgatactttgttcctcaagaagcaacctgcgaccgatagagcagcagtcgacaagtcgaccgctcgtgttcgtaccggagcgatttcggccatgggttcgtctttgcaagagatggctgagggcgcaaaggctgcagctcggctgcaggatcaactggctacaggcgaagccgtcgtgtccctggatccatccatgatcgacgggtcgccgatcgcggatcggctgccctcagacgtggatccgaaattcgagcagcttgaggcgagcatttcgcaggaggggcagcaggtgccggttcttgtcagaccgcaccctgaggctgccggtcgatatcagatcgtatatggaaggcggcggctgcgcgcggcagtaaatctgcggagagaggtttctgccattgttcgaaatctcacggactgtgaactggtcgtggcccagggccgcgaaaatcttaaccgcgctgacctctcgttcattgagaaggctctcttcgccctgcgcctcgaagatgcgggttttgatagagccaccatcattgccgcgctatccactgacaaggccgacctcagccgctacataactgtagcaaggggcataccgctgaacctcgccacacaaatcggcccagcgtcgaaagcgggtcgatcgcgttgggtcgtacttgccgaggggcttgggaagcctaaggcaacggacgcaatcgaagcgatgcttgggtcagagcagttcaagcaatctgatagcgatacccgctttaacctcattttcaacgccgtttcaaggccacctgcgaagactccaaaaaaggtaagggcctggagcacgccaaaggggaaaaaggcagcgacgatccgacaagaaactggacgaacggcgctggttttcgacgagagactggtgccaacttttggcgaatatgtcgctgaccagttggacagtctgtacgcccagttcattgaaaccaacggaggaggcaagctcgaccaatagtcagggtttcatccaatttaaagctccgctcgactgagatggactggctctcaccgcaaaagaaaaaggcccccgaaacggcgttccggaagaccttctctgtagtctcgcagctaagagaatcgcatttccaggaatcgtagtcaagggtcccgtaagggaaagcgtcatttcgacgggcggatttcaattgcctaacaaaaggtaaaaggaaatgcagacgcatatctcaacgacgtcctttgggcggcggccgatgacactcggccatattgcaagccagatggcagcaaaagcggtcgcatcagacactgtcgcccacaaatggcaggtcttccagcacatccgtgaatcccggggactgatcggagccacggaccgctcactctcgatcctgaacgcgctgttgacgttttacccggagaccgccttgactggtggtgccgaactggtcgtatggccttctaacgaacagctgatggctcgcgccaacggcatgcccgccacgacactgcgccggcatcttgccatactggttgattgcgggctcatcattcgccgcgacagccccaatggcaagcggttcgcccgcaagggaaggggaggggagattgagcaggcctatgggttcgatctgtcgccgatcgtcgcgcgggccgaggagttccgagatctggcccagacagtgcaagctgaaaaaaaggccttccgggtggccaaggagcgcttgactcttcttcgtcgtgacattgtcaaaatgatcgaaactggcgtcgaagagagcgttcctggaaactggggaagagttacccagacctatcaggggatcatcggccgcctgccacgctcggcacctcggcagcttgtcgagagtattgggcaagagcttcaggaactctgcatcgagatccgtgacgtattggaatctttcacaaaaacgatgaatctggacgccaatgagtcccatatcggtcgccacaaacagaattcaaatccagactctaaatttgaatctgaatacagctctggaaaaaaagatgaagcgggcggcagcgttgcggaaaccgacaatgtacggagcttgccgaaacgcgagctgcctttgggaatcgtgctggatgcctgccccgaaatgcgggaattggcccagggaggtccaattcggcattggcgcgacttgctggcggcggctgagcttgcccggccgatgctggggattagtccgagcgcctggcgggaggcccgcgaaaccatgggcgatcaacacgcggcgatcacgctggcttcgatctatcagcgggccggtcagatcaataacgctgggggctatctgcgcagcctgaccgaccgggccaaggatgggaagttttcgacctggccgatggtcatggcgttgctccgggcaaagctggacgagcagaagaatgcagttggcgctggaaagccgcgaactgctgaggaggtcgaggatgacagccgcctccacgtatcggaatcgctgctcaaaaacctgcgaaagccgagatcttggtgatcctctcgctattcagccgcggcgatgtcgacgtcggtgatcaacccggaacgtcgggcgcggtcgatcaggttcttgacggacgagggcgcccatttggatccaccgcgcggcgtgcgctcgtgcagtctttcaagctggccggcgatctcgcggagcttcaggtctgggttcgaagaatggatgccggccacaagcgtcatcaggcgatcttcgggaagacggggaggagattttttcaggagcgctgcatccaccaggcgttccgtcaccatccacttcacggctcggcgaagacgttctggcgtccagtcgaggccccgctgcttgagcattcgggcgatgtcgtcccatgtgtgatccggtcgcatgcgacgaacggtaggaagccattggttcgcggacgcctgaatcctatcgccatatgccgctttctgggccgcggtcatccttgccagcgcctccgggcgcttttcccggatgcccgggttgccggaaagcttccctaggcacaaacgttgactcttggatcgagctggcagacaaagcaataacccacacagaggacgattaatggctgacgaagagatccagaatccgccggacggtactgctgctgccgaagttgagccggctgctcctagaggtagaagagcaaagaaagcaccagccgaaacagcccgcacgggatcgttcaaatccgtgaagccgaaaacccgcggcctcagcaaccgagaaaaactggagaagatcggtcaaatcgaagctcaggtcgctggcggcgcaaccttgaaggacgccgttaagatcgtgggtatttccgttcagacctattatcaatggaagagagctgcggttcaacctgtctcacagaatccggccgtgtctgtttcagttgacgatgaactcggcgagttcatccaactcgaggaggaaaatcggcggctcagaaagcttcacgctgccgcaagcactcagggcgcaagggctgctaaaggaagcggaacacgtagaaagccagtccgcagaaacggtgctgaccccggatgaatgtcagctactgggctatctggacaagggaaaacgcaagcgcaaagagaaagcaggtagcttgcagtgggcttacatggcgatagctagactgggcggttttatggacagcaagcgaaccggaattgccagctggggcgccctctgggaaggttgggaagccctgcaaagtaaactggatggctttcttgccgccaaggatctgatggcgcaggggatcaagatctgatcaagagacaggggccggcccacgctgtcgtccaatctcccaagacacgccgccaccgcgcaccgtcgcggcgagctgctccccaagccgctgttcgatgggcttccaccgcacgaggctggaccccttggcgtcatcaagcatcccatttcgcccgctggcgagcatgacggggcgccggtagacgccggcaacgcgctggccgtcggccacggggcgatgctccaggccggtatcggcggcaatgtccttcgcggcctgcgccagttcccgagcccgctgctgcccagcagattccggtgaggatcacgcgctgcccgcgccgctcggccagtccctgttcggccaggaagtccgcgcgctgctgtatcgcctacttggcctcactgctaaagcccaggtcgcccaagcccgagccaccgtcgatcaactgctggtcaagccaggtggcaccgatcacgcgggcctgccgctcgatgggcaggtgcgatttcagctccaccgtcacgccaccaagacgctgggcgtcatagcggcggccctgctcgggcagatcgtccggcaccttccatagtccctcggccacgcacaccacgatgccggcctggtgcagggcttcgaggcggcgggtgtggcccgcaacgacttccagcggatcacgcccgacacggcctgacctagctcgacgaccaggtgagatcggtgaccgcgctagtcaagcaaccggcgtgccatggcgtttacggccagatcaatcgcagcgccctcgccctcgccgtcgccgtcgccgatgaaccaggctgccgacaagcccgtccatgcaatgatccagcgaagaagccgttcgggctcaaacccggtcgtcgcgaccacaatgctgagtcgagcctccagcctgcccggcaggatcgcaagcgggcgaccggggtcgctgagatcgggattcgtgaagatgttggcatagtcgaaggtgcgctcgccgagcagtccgtgcgggtcgatggccagccagccgcggtcgccgaagtcgagcacgttctcgtggtgcaggtcgccgtggagcgggcacacctcgcgcggcgccgccagaagttggcgcgctacgctggcggcgggcgcaagtgccgcgtgctcagcggccaaccggaaaagcggctggaaccattcctgtagcggatggagatcgggcggcggtccggaccgcggcgcgtgcagacgagcggcggtgtcgcagaggatcgtggcatcaccgaaccgcgccgtgcgcgggtcgtcggtgagccagagtttcagcaggccgcccaggcggcccaggtcgccattgatgcgggccagctcgcggacgtgctcatagtccacgacgcccgtgattttgtagccctggccgacggccagcaggtaggccgacaggctcatgccggccgccgccgccttttcctcaatcgctcttcgttcgtctggaaggcagtacaccttgataggtgggctgcccttcctggttggcttggtttcatcagccatccgcttgccctcatctgttacgccggcggtagccggccagcctcgcagagcaggattcccgttgagcaccgccaggtgcgaataagggacagtgaagaaggaacacccgctcgcgggtgggcctacttcacctatcctgcccggctgacgccgttggatacaccaaggaaagtctacacgaaccctttggcaaaatcctgtatatcgtgcgaaaaaggatggatataccgaaaaaatcgctataatgaccccgaagcagggttatgcagcggaaaagcgctgcttccctgctgttttgtggaatatctaccgactggaaacaggcaaatgcaggaaattactgaactgaggggacaggcgagagacgatgccaaagagctacaccgacgagctggccgagtgggttgaatcccgcgcggccaagaagcgccggcgtgatgaggctgcggttgcgttcctggcggtgagggcggatgtcgaggcggcgttagcgtccggctatgcgctcgtcaccatttgggagcacatgcgggaaacggggaaggtcaagttctcctacgagacgttccgctcgcacgccaggcggcacatcaaggccaagcccgccgatgtgcccgcaccgcaggccaaggctgcggaacccgcgccggcacccaagacgccggagccacggcggccgaagcaggggggcaaggctgaaaagccggcccccgctgcggccccgaccggcttcaccttcaacccaacaccggacaaaaaggatcaaccgggctgcatccgatgcaagtgtgtcgctgtcgactcgttgtacaacgaaatccattcccattccgcgctcaagatggcttcccctcggcagttcatcagggctaaatcaatctagccgacttgtccggtgaaatgggctgcactccaacagaaacaatcaaacaaacatacacagcgacttattcacacgagctcaaattacaacggtatatat

SEQ ID NO: 5 - DNA, 26802 bp, Artificial Sequence
  plasmid
ttgacatacaaatggacgaacggataaaccttttcacgcccttttaaatatccgattattctaataaacgctcttttctcttaggtttacccgccaatatatcctgtcaaacactgatagtttaaactgaaggcgggaaacgacaatctgatcactgattagtaactaaggcctttaattaatctagaggcgcgccgggccccctgcagggagctcggccggccaatttaaattgatatcggtacatcgattacgccaagctatcaactttgtatagaaaagttgccatgattacgccaagcttggccactaaggccaatttcgcgccctgcagcaaatttacacattgccactaaacgtctaaacccttgtaatttgtttttgttttactatgtgtgttatgtatttgatttgcgataaatttttatatttggtactaaatttataacaccttttatgctaacgtttgccaacacttagcaatttgcaagttgattaattgattctaaattatttttgtcttctaaatacatatactaatcaactggaaatgtaaatatttgctaatatttctactataggagaattaaagtgagtgaatatggtaccacaaggtttggagatttaattgttgcaatgctgcatggatggcatatacaccaaacattcaataattcttgaggataataatggtaccacacaagatttgaggtgcatgaacgtcacgtggacaaaaggtttagtaatttttcaagacaacaatgttaccacacacaagttttgaggtgcatgcatggatgccctgtggaaagtttaaaaatattttggaaatgatttgcatggaagccatgtgtaaaaccatgacatccacttggaggatgcaataatgaagaaaactacaaatttacatgcaactagttatgcatgtagtctatataatgaggattttgcaatactttcattcatacacactcactaagttttacacgattataatttcttcatagccagtactgtttaagcttcactgtctctgaatcggcaaaggtaaacgtatcaattattctacaaacccttttatttttcttttgaattaccgtcttcattggttatatgataacttgataagtaaagcttcaataattgaatttgatctgtgtttttttggccttaatactaaatccttacataagctttgttgcttctcctcttgtgagttgagtgttaagttgtaataatggttcactttcagctttagaagaaaccatggaagttgttgagaggttctacggagagttggatggaaaggtttcccaaggagtgaacgctttgttgggatctttcggagttgagttgactgataccccaactactaagggattgccactcgttgattctccaactccaattgtgttgggagtgtctgtttacttgaccatcgtgatcggaggattgctttggatcaaggctagagatctcaagccaagagcttctgagccattcttgttgcaagctttggtgttggtgcacaacttgttctgcttcgctttgtctctttacatgtgcgtgggtatcgcttaccaagctatcacctggagatattccttgtggggaaacgcttataacccaaagcacaaggagatggctatcctcgtttacctcttctacatgtccaagtacgtggagttcatggataccgtgatcatgatcctcaagagatccaccagacagatttctttcctccacgtgtaccaccactcttctatctcccttatctggtgggctattgctcaccacgctccaggaggagaggcttattggagtgctgctctcaactctggagtgcacgtgttgatgtacgcttactacttcttggctgcttgcttgagatcttccccaaagctcaagaacaagtacctcttctggggaagatacctcacccaattccagatgttccagttcatgctcaacttggtgcaagcttactacgatatgaaaaccaacgctccatatccacaatggctcatcaagatcctcttctactacatgatctccctcttgttcctcttcggaaacttctacgtgcaaaagtacatcaagccatccgatggaaagcaaaagggagctaagaccgagtgatcgacaagctcgagtttctccataataatgtgtgagtagttcccagataagggaattagggttcctatagggtttcgctcatgtgttgagcatataagaaacccttagtatgtatttgtatttgtaaaatacttctatcaataaaatttctaattcctaaaaccaaaatccagtactaaaatccagatcccccgaattaattcggcgttaattcagggccggccaaagtaggcgcctactaccggtaattcccgggattagcggccgctagtctgtgcgcacttgtatcctgcaggttaggccggccattagcagatatttggtgtctaaatgtttattttgtgatatgttcatgtttgaaatggtggtttcgaaaccagggacaacgttgggatctgatagggtgtcaaagagtattatggattgggacaatttcggtcatgagttgcaaattcaagtatatcgttcgattatgaaaattttcgaagaatatcccatttgagagagtctttacctcattaatgtttttagattatgaaattttatcatagttcatcgtagtctttttggtgtaaaggctgtaaaaagaaattgttcacttttgttttcgtttatgtgaaggctgtaaaagattgtaaaagactattttggtgttttggataaaatgatagtttttatagattcttttgcttttagaagaaatacatttgaaattttttccatgttgagtataaaataccgaaatcgattgaagatcatagaaatattttaactgaaaacaaatttataactgattcaattctctccatttttatacctatttaaccgtaatcgattctaatagatgatcgattttttatataatcctaattaaccaacggcatgtattggataattaaccgatcaactctcacccctaatagaatcagtattttccttcgacgttaattgatcctacactatgtaggtcatatccatcgttttaatttttggccaccattcaattctgtcttgcctttagggatgtgaatatgaacggccaaggtaagagaataaaaataatccaaattaaagcaagagaggccaagtaagataatccaaatgtacacttgtcattgccaaaattagtaaaatactcggcatattgtattcccacacattattaaaataccgtatatgtattggctgcatttgcatgaataatactacgtgtaagcccaaaagaacccacgtgtagcccatgcaaagttaacactcacgaccccattcctcagtctccactatataaacccaccatccccaatctcaccaaacccaccacacaactcacaactcactctcacaccttaaagaaccaatcaccaccaaaaaatttcacgatttggaatttgattcctgcgatcacaggtatgacaggttagattttgttttgtatagttgtatacatacttctttgtgatgttttgtttacttaatcgaatttttggagtgttttaaggtctctcgtttagaaatcgtggaaaatatcactgtgtgtgtgttcttatgattcacagtgtttatgggtttcatgttctttgttttatcattgaatgggaagaaatttcgttgggatacaaatttctcatgttcttactgatcgttattaggagtttggggaaaaaggaagagtttttttggttggttcgagtgattatgaggttatttctgtatttgatttatgagttaatggtcgttttaatgttgtagaccatgggaaaaggatctgagggaagatctgctgctagagagatgactgctgaggctaacggagataagagaaagaccatcctcattgagggagtgttgtacgatgctaccaacttcaaacacccaggaggttccattattaacttcctcaccgagggagaagctggagttgatgctacccaagcttacagagagttccatcagagatccggaaaggctgataagtacctcaagtccctcccaaagttggatgcttctaaggtggagtctaggttctctgctaaggagcaggctagaagggacgctatgaccagggattacgctgctttcagagaggagttggttgctgagggatacttcgatccatctatcccacacatgatctacagagtggtggagattgtggctttgttcgctttgtctttctggttgatgtctaaggcttctccaacctctttggttttgggagtggtgatgaacggaatcgctcaaggaagatgcggatgggttatgcacgagatgggacacggatctttcactggagttatctggctcgatgataggatgtgcgagttcttctacggagttggatgtggaatgtctggacactactggaagaaccagcactctaagcaccacgctgctccaaacagattggagcacgatgtggatttgaacaccttgccactcgttgctttcaacgagagagttgtgaggaaggttaagccaggatctttgttggctttgtggctcagagttcaggcttatttgttcgctccagtgtcttgcttgttgatcggattgggatggaccttgtacttgcacccaagatatatgctcaggaccaagagacacatggagtttgtgtggatcttcgctagatatatcggatggttctccttgatgggagctttgggatattctcctggaacttctgtgggaatgtacctctgctctttcggacttggatgcatctacatcttcctccaattcgctgtgtctcacacccacttgccagttaccaacccagaggatcaattgcactggcttgagtacgctgctgatcacaccgtgaacatctctaccaagtcttggttggttacctggtggatgtctaacctcaacttccaaatcgagcaccacttgttcccaaccgctccacaattcaggttcaaggagatctctccaagagttgaggctctcttcaagagacacaacctcccttactacgatttgccatacacctctgctgtttctactaccttcgctaacctctactctgttggacactctgttggagctgataccaagaagcaggattgactgctttaatgagatatgcgagacgcctatgatcgcatgatatttgctttcaattctgttgtgcacgttgtaaaaaacctgagcatgtgtagctcagatccttaccgccggtttcggttcattctaatgaatatatcacccgttactatcgtatttttatgaataatattctccgttcaatttactgattgtgtcgacgcgatcgcgtgcaaacactgtacggaccgtggcctaataggccggtacccaagtttgtacaaaaaagcaggctccatgattacgccaagcttggccactaaggccaatttaaatctactaggccggccatcgacggcccggactgtatccaacttctgatctttgaatctctctgttccaacatgttctgaaggagttctaagacttttcagaaagcttgtaacatgctttgtagactttctttgaattactcttgcaaactctgattgaacctacgtgaaaactgctccagaagttctaaccaaattccgtcttgggaaggcccaaaatttattgagtacttcagtttcatggacgtgtcttcaaagatttataacttgaaatcccatcatttttaagagaagttctgttccgcaatgtcttagatctcattgaaatctacaactcttgtgtcagaagttcttccagaatcaacttgcatcatggtgaaaatctggccagaagttctgaacttgtcatatttcttaacagttagaaaaatttctaagtgtttagaattttgacttttccaaagcaaacttgacttttgactttcttaataaaacaaacttcatattctaacatgtcttgatgaaatgtgattcttgaaatttgatgttgatgcaaaagtcaaagtttgacttttcagtgtgcaattgaccattttgctcttgtgccaattccaaacctaaattgatgtatcagtgctgcaaacttgatgtcatggaagatcttatgagaaaattcttgaagactgagaggaaaaattttgtagtacaacacaaagaatcctgtttttcatagtcggactagacacattaacataaaacaccacttcattcgaagagtgattgaagaaggaaatgtgcagttacctttctgcagttcataagagcaacttacagacacttttactaaaatactacaaagaggaagattttaacaacttagagaagtaatgggagttaaagagcaacacattaagggggagtgttaaaattaatgtgttgtaaccaccactacctttagtaagtattataagaaaattgtaatcatcacattataattattgtccttatttaaaattatgataaagttgtatcattaagattgagaaaaccaaatagtcctcgtcttgatttttgaattattgttttctatgttacttttcttcaagcctatataaaaactttgtaatgctaaattgtatgctggaaaaaaatgtgtaatgaattgaatagaaattatggtatttcaaagtccaaaatccatcaatagaaatttagtacaaaacgtaactcaaaaatattctcttattttaaattttacaacaatataaaaatattctcttattttaaattttacaataatataatttatcacctgtcacctttagaataccaccaacaatattaatacttagatattttattcttaataattttgagatctctcaatatatctgatatttattttatatttgtgtcatattttcttatgttttagagttaacccttatatcttggtcaaactagtaattcaatatatgagtttgtgaaggacacattgacatcttgaaacattggttttaaccttgttggaatgttaaaggtaataaaacattcagaattatgaccatctattaatatacttcctttgtcttttaaaaaagtgtgcatgaaaatgctctatggtaagctagagtgtcttgctggcctgtgtatatcaattccatttccagatggtagaaactgccactacgaataattagtcataagacacgtatgttaacacacgtccccttgcatgttttttgccatatattccgtctctttctttttcttcacgtataaaacaatgaactaattaatagagcgatcaagctgaacagttctttgctttcgaagttgccgcaacctaaacaggtttttccttcttctttcttcttattaactacgaccttgtcctttgcctatgtaaaattactaggttttcatcagttacactgattaagttcgttatagtggaagataaaatgccctcaaagcattttgcaggatatctttgatttttcaaagatatggaactgtagagtttgatagtgttcttgaatgtggttgcatgaagtttttttggtctgcatgttattttttcctcgaaatatgttttgagtccaacaagtgattcacttgggattcagaaagttgttttctcaatatgtaacagtttttttctatggagaaaaatcatagggaccgttggttttggcttctttaattttgagctcagattaaacccattttacccggtgttcttggcagaattgaaaacagtacgtagtaccgcgcctaccatgtgtgttgagaccgagaacaacgatggaatccctactgtggagatcgctttcgatggagagagagaaagagctgaggctaacgtgaagttgtctgctgagaagatggaacctgctgctttggctaagaccttcgctagaagatacgtggttatcgagggagttgagtacgatgtgaccgatttcaaacatcctggaggaaccgtgattttctacgctctctctaacactggagctgatgctactgaggctttcaaggagttccaccacagatctagaaaggctaggaaggctttggctgctttgccttctagacctgctaagaccgctaaagtggatgatgctgagatgctccaggatttcgctaagtggagaaaggagttggagagggacggattcttcaagccttctcctgctcatgttgcttacagattcgctgagttggctgctatgtacgctttgggaacctacttgatgtacgctagatacgttgtgtcctctgtgttggtttacgcttgcttcttcggagctagatgtggatgggttcaacacgagggaggacactcttctttgaccggaaacatctggtgggataagagaatccaagctttcactgctggattcggattggctggatctggagatatgtggaactccatgcacaacaagcaccacgctactcctcaaaaagtgaggcacgatatggatttggataccactcctgctgttgctttcttcaacaccgctgtggaggataatagacctaggggattctctaagtactggctcagattgcaagcttggaccttcattcctgtgacttctggattggtgttgctcttctggatgttcttcctccacccttctaaggctttgaagggaggaaagtacgaggagcttgtgtggatgttggctgctcacgtgattagaacctggaccattaaggctgttactggattcaccgctatgcaatcctacggactcttcttggctacttcttgggtttccggatgctacttgttcgctcacttctctacttctcacacccacttggatgttgttcctgctgatgagcacttgtcttgggttaggtacgctgtggatcacaccattgatatcgatccttctcagggatgggttaactggttgatgggatacttgaactgccaagtgattcaccacctcttcccttctatgcctcaattcagacaacctgaggtgtccagaagattcgttgctttcgctaagaagtggaacctcaactacaaggtgatgacttatgctggagcttggaaggctactttgggaaacctcgataatgtgggaaagcactactacgtgcacggacaacactctggaaagaccgcttgattaattaaggccgcctcgaccgtaccccctgcagatagactatactatgttttagcctgcctgctggctagctactatgttatgttatgttgtaaaataaacacctgctaaggtatatctatctatattttagcatggctttctcaataaattgtctttccttatcgtttactatcttatacctaataatgaaataataatatcacatatgaggaacggggcaggtttaggcatatatatacgagtgtagggcggagtggggggcgcctactaccggtaattcccgggattagcggccgctagtctgtgcgcacttgtatcctgcaggttaggccggccacacgggcaggacatagggactactacaagcatagtatgcttcagacaaagagctaggaaagaactcttgatggaggttaagagaaaaaagtgctagaggggcatagtaatcaaacttgtcaaaaccgtcatcatgatgagggatgacataatataaaaagttgactaaggtcttggtagtactctttgattagtattatatattggtgagaacatgagtcaagaggagacaagaaaccgaggaaccatagtttagcaacaagatggaagttgcaaagttgagctagccgctcgattagttacatctcctaagcagtactacaaggaatggtctctatactttcatgtttagcacatggtagtgcggattgacaagttagaaacagtgcttaggagacaaagagtcagtaaaggtattgaaagagtgaagttgatgctcgacaggtcaggagaagtccctccgccagatggtgactaccaaggggttggtatcagctgagacccaaataagattcttcggttgaaccagtggttcgaccgagactcttagggtgggatttcactgtaagatttgtgcattttgttgaatataaattgacaattttttttatttaattatagattatttagaatgaattacatatttagtttctaacaaggatagcaatggatgggtatgggtacaggttaaacatatctattacccacccatctagtcgtcgggttttacacgtacccacccgtttacataaaccagaccggaattttaaaccgtacccgtccgttagcgggtttcagatttacccgtttaatcgggtaaaacctgattactaaatatatattttttatttgataaacaaaacaaaaatgttaatattttcatattggatgcaattttaagaaacacatattcataaatttccatatttgtaggaaaataaaaagaaaaatatattcaagaacacaaatttcaccgacatgacttttattacagagttggaattagatctaacaattgaaaaattaaaattaagatagaatatgttgaggaacatgacatagtataatgctgggttacccgtcgggtaggtatcgaggcggatactactaaatccatcccactcgctatccgataatcactggtttcgggtatacccattcccgtcaacaggcctttttaaccggataatttcaacttatagtgaatgaattttgaataaatagttagaataccaaaatcctggattgcatttgcaatcaaattttgtgaaccgttaaattttgcatgtacttgggatagatataatagaaccgaattttcattagtttaatttataacttactttgttcaaagaaaaaaaatatctatccaatttacttataataaaaaataatctatccaagttacttattataatcaacttgtaaaaaggtaagaatacaaatgtggtagcgtacgtgtgattatatgtgacgaaatgttatatctaacaaaagtccaaattcccatggtaaaaaaaatcaaaatgcatggcaggctgtttgtaaccttggaataagatgttggccaattctggagccgccacgtacgcaagactcagggccacgttctcttcatgcaaggatagtagaacaccactccacccacctcctatattagacctttgcccaaccctccccaactttcccatcccatccacaaagaaaccgacatttttatcataaatctggtgcttaaacactctggtgagttctagtacttctgctatgatcgatctcattaccatttcttaaatttctctccctaaatattccgagttcttgatttttgataacttcaggttttctctttttgataaatctggtctttccatttttttttttttgtggttaatttagtttcctatgttcttcgattgtattatgcatgatctgtgtttggattctgttagattatgtattggtgaatatgtatgtgtttttgcatgtctggttttggtcttaaaaatgttcaaatctgatgatttgattgaagcttttttagtgttggtttgattcttctcaaaactactgttaatttactatcatgttttccaactttgattcatgatgacacttttgttctgctttgttataaaattttggttggtttgattttgtaattatagtgtaattttgttaggaatgaacatgttttaatactctgttttcgatttgtcacacattcgaattattaatcgataatttaactgaaaattcatggttctagatcttgttgtcatcagattatttgtttcgataattcatcaaatatgtagtccttttgctgatttgcgactgtttcattttttctcaaaattgttttttgttaagtttatctaacagttatcgttgtcaaaagtctctttcattttgcaaaatcttctttttttttttgtttgtaactttgttttttaagctacacatttagtctgtaaaatagcatcgaggaacagttgtcttagtagacttgcatgttcttgtaacttctatttgtttcagtttgttgatgactgctttgattttgtaggtcaaaggcgcgccctaccatggatgcttataacgctgctatggataagattggagctgctatcatcgattggagtgatccagatggaaagttcagagctgatagggaggattggtggttgtgcgatttcagatccgctatcaccattgctctcatctacatcgctttcgtgatcttgggatctgctgtgatgcaatctctcccagctatggacccataccctatcaagttcctctacaacgtgtctcaaatcttcctctgcgcttacatgactgttgaggctggattcctcgcttataggaacggatacaccgttatgccatgcaaccacttcaacgtgaacgatccaccagttgctaacttgctctggctcttctacatctccaaagtgtgggatttctgggataccatcttcattgtgctcggaaagaagtggagacaactctctttcttgcacgtgtaccaccacaccaccatcttcctcttctactggttgaacgctaacgtgctctacgatggagatatcttcttgaccatcctcctcaacggattcattcacaccgtgatgtacacctactacttcatctgcatgcacaccaaggattctaagaccggaaagtctttgccaatctggtggaagtcatctttgaccgctttccaactcttgcaattcaccatcatgatgtcccaagctacctacttggttttccacggatgcgataaggtttccctcagaatcaccatcgtgtacttcgtgtacattctctcccttttcttcctcttcgctcagttcttcgtgcaatcctacatggctccaaagaagaagaagtccgcttgatgttaattaaggccgcagatatcagatctggtcgacctagaggatccccggccgcaaagataataacaaaagcctactatataacgtacatgcaagtattgtatgatattaatgtttttacgtacgtgtaaacaaaaataattacgtttgtaacgtatggtgatgatgtggtgcactaggtgtaggccttgtattaataaaaagaagtttgttctatatagagtggtttagtacgacgatttatttactagtcggattggaatagagaaccgaattcttcaatccttgcttttgatcaagaattgaaaccgaatcaaatgtaaaagttgatatatttgaaaaacgtattgagcttatgaaaatgctaatactctcatctgtatggaaaagtgactttaaaaccgaacttaaaagtgacaaaaggggaatatcgcatcaaaccgaatgaaaccgatggcgcctaccggtatcggtccgattgcggccgcttaaagggcgaattcgtttaaacactgtacggaccgtggcctaataggccggtaccacccagctttcttgtacaaagtggccatgattacgccaagcttggccactaaggccaatttaaatctactaggccggccataaggatgacctacccattcttgagacaaatgttacattttagtatcagagtaaaatgtgtacctataactcaaattcgattgacatgtatccattcaacataaaattaaaccagcctgcacctgcatccacatttcaagtattttcaaaccgttcggctcctatccaccgggtgtaacaagacggattccgaatttggaagattttgactcaaattcccaatttatattgaccgtgactaaatcaactttaacttctataattctgattaagctcccaatttatattcccaacggcactacctccaaaatttatagactctcatccccttttaaaccaacttagtaaacgttttttttttaattttatgaagttaagtttttaccttgtttttaaaaagaatcgttcataagatgccatgccagaacattagctacacgttacacatagcatgcagccgcggagaattgtttttcttcgccacttgtcactcccttcaaacacctaagagcttctctctcacagcacacacatacaatcacatgcgtgcatgcattattacacgtgatcgccatgcaaatctcctttatagcctataaattaactcatcggcttcactctttactcaaaccaaaactcatcaatacaaacaagattaaaaacatttcacgatttggaatttgattcctgcgatcacaggtatgacaggttagattttgttttgtatagttgtatacatacttctttgtgatgttttgtttacttaatcgaatttttggagtgttttaaggtctctcgtttagaaatcgtggaaaatatcactgtgtgtgtgttcttatgattcacagtgtttatgggtttcatgttctttgttttatcattgaatgggaagaaatttcgttgggatacaaatttctcatgttcttactgatcgttattaggagtttggggaaaaaggaagagtttttttggttggttcgagtgattatgaggttatttctgtatttgatttatgagttaatggtcgttttaatgttgtagaccgccatggctattttgaaccctgaggctgattctgctgctaacctcgctactgattctgaggctaagcaaagacaattggctgaggctggatacactcatgttgagggtgctcctgctcctttgcctttggagttgcctcatttctctctcagagatctcagagctgctattcctaagcactgcttcgagagatctttcgtgacctccacctactacatgatcaagaacgtgttgacttgcgctgctttgttctacgctgctaccttcattgatagagctggagctgctgcttatgttttgtggcctgtgtactggttcttccagggatcttacttgactggagtgtgggttatcgctcatgagtgtggacatcaggcttattgctcttctgaggtggtgaacaacttgattggactcgtgttgcattctgctttgttggtgccttaccactcttggagaatctctcacagaaagcaccattccaacactggatcttgcgagaacgatgaggttttcgttcctgtgaccagatctgtgttggcttcttcttggaacgagaccttggaggattctcctctctaccaactctaccgtatcgtgtacatgttggttgttggatggatgcctggatacctcttcttcaacgctactggacctactaagtactggggaaagtctaggtctcacttcaacccttactccgctatctatgctgatagggagagatggatgatcgtgctctccgatattttcttggtggctatgttggctgttttggctgctttggtgcacactttctccttcaacaccatggtgaagttctacgtggtgccttacttcattgtgaacgcttacttggtgttgattacctacctccaacacaccgatacctacatccctcatttcagagagggagagtggaattggttgagaggagctttgtgcactgtggatagatcatttggtccattcctcgattctgtggtgcatagaatcgtggatacccatgtttgccaccacatcttctccaagatgcctttctatcattgcgaggaggctaccaacgctattaagcctctcctcggaaagttctacttgaaggataccactcctgttcctgttgctctctggagatcttacacccattgcaagttcgttgaggatgatggaaaggtggtgttctacaagaacaagctctagttaattaataattgattggttcgagtattatggcattgggaaaactgtttttcttgtaccatttgttgtgcttgtaatttactgtgttttttattcggttttcgctatcgaactgtgaaatggaaatggatggagaagagttaatgaatgatatggtccttttgttcattctcaaattaatattatttgttttttctcttatttgttgtgtgttgaatttgaaattataagagatatgcaaacattttgttttgagtaaaaatgtgtcaaatcgtggcctctaatgaccgaagttaatatgaggagtaaaacacttgtagttgtaccattatgcttattcactaggcaacaaatatattttcagacctagaaaagctgcaaatgttactgaatacaagtatgtcctcttgtgttttagacatttatgaactttcctttatgtaattttccagaatccttgtcagattctaatcattgctttataattatagttatactcatggatttgtagttgagtatgaaaatattttttaatgcattttatgacttgccaattgattgacaacatgcatcaatggcgcctactaccggtaattcccgggattagcggccgctagtctgtgcgcacttgtatcctgcaggtcaatcgtttaaacactgtacggaccgtggcctaataggccggtacccaactttattatacatagttgataattcactggccggatgtaccgaattcgcggccgcaagcttgtacactagtacgcgtcaattggcgatcgcggatctgagatgaaaccggtgattatcagaaccttttatggtctttgtatgcatatggtaaaaaaacttagtttgcaatttcctgtttgttttggtaatttgagtttcttttagttgttgatctgcctgctttttggtttacgtcagactactactgctgttgttgtttggtttcctttctttcattttataaataaataatccggttcggtttactccttgtgactggctcagtttggttattgcgaaatgcgaatggtaaattgagtaattgaaattcgttattagggttctaagctgttttaacagtcactgggttaatatctctcgaatcttgcatggaaaatgctcttaccattggtttttaattgaaatgtgctcatatgggccgtggtttccaaattaaataaaactacgatgtcatcgagaagtaaaatcaactgtgtccacattatcagttttgtgtatacgatgaaatagggtaattcaaaatctagcttgatatgccttttggttcattttaaccttctgtaaacattttttcagattttgaacaagtaaatccaaaaaaaaaaaaaaaaaatctcaactcaacactaaattattttaatgtataaaagatgcttaaaacatttggcttaaaagaaagaagctaaaaacatagagaactcttgtaaattgaagtatgaaaatatactgaattgggtattatatgaatttttctgatttaggattcacatgatccaaaaaggaaatccagaagcactaatcagacattggaagtaggaatatttcaaaaagtttttttttttaagtaagtgacaaaagcttttaaaaaatagaaaagaaactagtattaaagttgtaaatttaataaacaaaagaaattttttatattttttcatttctttttccagcatgaggttatgatggcaggatgtggatttcatttttttccttttgatagccttttaattgatctattataattgacgaaaaaatattagttaattatagatatattttaggtagtattagcaatttacacttccaaaagactatgtaagttgtaaatatgatgcgttgatctcttcatcattcaatggttagtcaaaaaaataaaagcttaactagtaaactaaagtagtcaaaaattgtactttagtttaaaatattacatgaataatccaaaacgacatttatgtgaaacaaaaacaatatagatccattaccctgttatccctagaggggaaaattcgaatccaaaaattacggatatgaatataggcatatccgtatccgaattatccgtttgacagctagcaacgattgtacaattgcttctttaaaaaaggaagaaagaaagaaagaaaagaatcaacatcagcgttaacaaacggccccgttacggcccaaacggtcatatagagtaacggcgttaagcgttgaaagactcctatcgaaatacgtaaccgcaaacgtgtcatagtcagatcccctcttccttcaccgcctcaaacacaaaaataatcttctacagcctatatatacaacccccccttctatctctcctttctcacaattcatcatctttctttctctacccccaattttaagaaatcctctcttctcctcttcattttcaaggtaaatctctctctctctctctctctctgttattccttgttttaattaggtatgtattattgctagtttgttaatctgcttatcttatgtatgccttatgtgaatatctttatcttgttcatctcatccgtttagaagctataaatttgttgatttgactgtgtatctacacgtggttatgtttatatctaatcagatatgaatttcttcatattgttgcgtttgtgtgtaccaatccgaaatcgttgatttttttcatttaatcgtgtagctaattgtacgtatacatatggatctacgtatcaattgttcatctgtttgtgtttgtatgtatacagatctgaaaacatcacttctctcatctgattgtgttgttacatacatagatatagatctgttatatcattttttttattaattgtgtatatatatatgtgcatagatctggattacatgattgtgattatttacatgattttgttatttacgtatgtatatatgtagatctggactttttggagttgttgacttgattgtatttgtgtgtgtatatgtgtgttctgatcttgatatgttatgtatgtgcagctgaaccatggcggcggcaacaacaacaacaacaacatcttcttcgatctccttctccaccaaaccatctccttcctcctccaaatcaccattaccaatctccagattctccctcccattctccctaaaccccaacaaatcatcctcctcctcccgccgccgcggtatcaaatccagctctccctcctccatctccgccgtgctcaacacaaccaccaatgtcacaaccactccctctccaaccaaacctaccaaacccgaaacattcatctcccgattcgctccagatcaaccccgcaaaggcgctgatatcctcgtcgaagctttagaacgtcaaggcgtagaaaccgtattcgcttaccctggaggtacatcaatggagattcaccaagccttaacccgctcttcctcaatccgtaacgtccttcctcgtcacgaacaaggaggtgtattcgcagcagaaggatacgctcgatcctcaggtaaaccaggtatctgtatagccacttcaggtcccggagctacaaatctcgttagcggattagccgatgcgttgttagatagtgttcctcttgtagcaatcacaggacaagtccctcgtcgtatgattggtacagatgcgtttcaagagactccgattgttgaggtaacgcgttcgattacgaagcataactatcttgtgatggatgttgaagatatccctaggattattgaggaagctttctttttagctacttctggtagacctggacctgttttggttgatgttcctaaagatattcaacaacagcttgcgattcctaattgggaacaggctatgagattacctggttatatgtctaggatgcctaaacctccggaagattctcatttggagcagattgttaggttgatttctgagtctaagaagcctgtgttgtatgttggtggtggttgtttgaattctagcgatgaattgggtaggtttgttgagcttacggggatccctgttgcgagtacgttgatggggctgggatcttatccttgtgatgatgagttgtcgttacatatgcttggaatgcatgggactgtgtatgcaaattacgctgtggagcatagtgatttgttgttggcgtttggggtaaggtttgatgatcgtgtcacgggtaagcttgaggcttttgctagtagggctaagattgttcatattgatattgactcggctgagattgggaagaataagactcctcatgtgtctgtgtgtggtgatgttaagctggctttgcaagggatgaataaggttcttgagaaccgagcggaggagcttaagcttgattttggagtttggaggaatgagttgaacgtacagaaacagaagtttccgttgagctttaagacgtttggggaagctattcctccacagtatgcgattaaggtccttgatgagttgactgatggaaaagccataataagtactggtgtcgggcaacatcaaatgtgggcggcgcagttctacaattacaagaaaccaaggcagtggctatcatcaggaggccttggagctatgggatttggacttcctgctgcgattggagcgtctgttgctaaccctgatgcgatagttgtggatattgacggagatggaagctttataatgaatgtgcaagagctagccactattcgtgtagagaatcttccagtgaaggtacttttattaaacaaccagcatcttggcatggttatgcaatgggaagatcggttctacaaagctaaccgagctcacacatttctcggggatccggctcaggaggacgagatattcccgaacatgttgctgtttgcagcagcttgcgggattccagcggcgagggtgacaaagaaagcagatctccgagaagctattcagacaatgctggatacaccaggaccttacctgttggatgtgatttgtccgcaccaagaacatgtgttgccgatgatcccgaatggtggcactttcaacgatgtcataacggaaggagatggccggattaaatactgatagggataacagggtaatctcgacgagatgaaaccggtgattatcagaaccttttatggtctttgtatgcatatggtaaaaaaacttagtttgcaatttcctgtttgttttggtaatttgagtttcttttagttgttgatctgcctgctttttggtttacgtcagactactactgctgttgttgtttggtttcctttctttcattttataaataaataatccggttcggtttactccttgtgactggctcagtttggttattgcgaaatgcgaatggtaaattgagtaattgaaattcgttattagggttctaagctgttttaacagtcactgggttaatatctctcgaatcttgcatggaaaatgctcttaccattggtttttaattgaaatgtgctcatatgggccgtggtttccaaattaaataaaactacgatgtcatcgagaagtaaaatcaactgtgtccacattatcagttttgtgtatacgatgaaatagggtaattcaaaatctagcttgatatgccttttggttcattttaaccttctgtaaacattttttcagattttgaacaagtaaatccaaaaaaaaaaaaaaaaaatctcaactcaacactaaattattttaatgtataaaagatgcttaaaacatttggcttaaaagaaagaagctaaaaacatagagaactcttgtaaattgaagtatgaaaatatactgaattgggtattatatgaatttttctgatttaggattcacatgatccaaaaaggaaatccagaagcactaatcagacattggaagtaggaatatttcaaaaagttttttttttttaagtaagtgacaaaagcttttaaaaaatagaaaagaaactagtattaaagttgtaaatttaataaacaaaagaaattttttatattttttcatttctttttccagcatgaggttatgatggcaggatgtggatttcatttttttccttttgatagccttttaattgatctattataattgacgaaaaaatattagttaattatagatatattttaggtagtattagcaatttacacttccaaaagactatgtaagttgtaaatatgatgcgttgatctcttcatcattcaatggttagtcaaaaaaataaaagcttaactagtaaactaaagtagtcaaaaattgtactttagtttaaaatattacatgaataatccaaaacgacatttatgtgaaacaaaaacaatatgtcgaggcgatcgcagtacttaatcagtgatcagtaactaaattcagtacattaaagacgtccgcaatgtgttattaagttgtctaagcgtcaatttgtttacaccacaatatatcctgccaccagccagccaacagctccccgaccggcagctcggcacaaaatcactgatcatctaaaaaggtgatgtgtatttgagtaaaacagcttgcgtcatgcggtcgctgcgtatatgatgcgatgagtaaataaacaaatacgcaaggggaacgcatgaaggttatcgctgtacttaaccagaaaggcgggtcaggcaagacgaccatcgcaacccatctagcccgcgccctgcaactcgccggggccgatgttctgttagtcgattccgatccccagggcagtgcccgcgattgggcggccgtgcgggaagatcaaccgctaaccgttgtcggcatcgaccgcccgacgattgaccgcgacgtgaaggccatcggccggcgcgacttcgtagtgatcgacggagcgccccaggcggcggacttggctgtgtccgcgatcaaggcagccgacttcgtgctgattccggtgcagccaagcccttacgacatttgggccaccgccgacctggtggagctggttaagcagcgcattgaggtcacggatggaaggctacaagcggcctttgtcgtgtcgcgggcgatcaaaggcacgcgcatcggcggtgaggttgccgaggcgctggccgggtacgagctgcccattcttgagtcccgtatcacgcagcgcgtgagctacccaggcactgccgccgccggcacaaccgttcttgaatcagaacccgagggcgacgctgcccgcgaggtccaggcgctggccgctgaaattaaatcaaaactcatttgagttaatgaggtaaagagaaaatgagcaaaagcacaaacacgctaagtgccggccgtccgagcgcacgcagcagcaaggctgcaacgttggccagcctggcagacacgccagccatgaagcgggtcaactttcagttgccggcggaggatcacaccaagctgaagatgtacgcggtacgccaaggcaagaccattaccgagctgctatctgaatacatcgcgcagctaccagagtaaatgagcaaatgaataaatgagtagatgaattttagcggctaaaggaggcggcatggaaaatcaagaacaaccaggcaccgacgccgtggaatgccccatgtgtggaggaacgggcggttggccaggcgtaagcggctgggttgtctgccggccctgcaatggcactggaacccccaagcccgaggaatcggcgtgagcggtcgcaaaccatccggcccggtacaaatcggcgcggcgctgggtgatgacctggtggagaagttgaaggccgcgcaggccgcccagcggcaacgcatcgaggcagaagcacgccccggtgaatcgtggcaaggggccgctgatcgaatccgcaaagaatcccggcaaccgccggcagccggtgcgccgtcgattaggaagccgcccaagggcgacgagcaaccagattttttcgttccgatgctctatgacgtgggcacccgcgatagtcgcagcatcatggacgtggccgttttccgtctgtcgaagcgtgaccgacgagctggcgaggtgatccgctacgagcttccagacgggcacgtagaggtttccgcaggccccgccggcatggccagtgtgtgggattacgacctggtactgatggcggtttcccatctaaccgaatccatgaaccgataccgggaagggaagggagacaagcccggccgcgtgttccgtccacacgttgcggacgtactcaagttctgccggcgagccgatggcggaaagcagaaagacgacctggtagaaacctgcattcggttaaacaccacgcacgttgccatgcagcgtaccaagaaggccaagaacggccgcctggtgacggtatccgagggtgaagccttgattagccgctacaagatcgtaaagagcgaaaccgggcggccggagtacatcgagatcgagcttgctgattggatgtaccgcgagatcacagaaggcaagaacccggacgtgctgacggttcaccccgattactttttgatcgaccccggcatcggccgttttctctaccgcctggcacgccgcgccgcaggcaaggcagaagccagatggttgttcaagacgatctacgaacgcagtggcagcgccggagagttcaagaagttctgtttcaccgtgcgcaagctgatcgggtcaaatgacctgccggagtacgatttgaaggaggaggcggggcaggctggcccgatcctagtcatgcgctaccgcaacctgatcgagggcgaagcatccgccggttcctaatgtacggagcagatgctagggcaaattgccctagcaggggaaaaaggtcgaaaaggtctctttcctgtggatagcacgtacattgggaacccaaagccgtacattgggaaccggaacccgtacattgggaacccaaagccgtacattgggaaccggtcacacatgtaagtgactgatataaaagagaaaaaaggcgatttttccgcctaaaactctttaaaacttattaaaactcttaaaacccgcctggcctgtgcataactgtctggccagcgcacagccgaagagctgcaaaaagcgcctacccttcggtcgctgcgctccctacgccccgccgcttcgcgtcggcctatcgcggcctatgcggtgtgaaataccgcacagatgcgtaaggagaaaataccgcatcaggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtccttcaactcatcgatagtttggctgtgagcaattatgtgcttagtgcatctaacgcttgagttaagccgcgccgcgaagcggcgtcggcttgaacgaatttctagctagacattatttgccaacgaccttcgtgatctcgcccttgacatagtggacaaattcttcgagctggtcggcccgggacgcgagacggtcttcttcttggcccagataggcttggcgcgcttcgaggatcacgggctggtattgcgccggaaggcgctccatcgcccagtcggcggcgacatccttcggcgcgatcttgccggtaaccgccgagtaccaaatccggctcagcgtaaggaccacattgcgctcatcgcccgcccaatccggcggggagttccacagggtcagcgtctcgttcagtgcttcgaacagatcctgttccggcaccgggtcgaaaagttcctcggccgcggggccgacgagggccacgctatgctcccgggccttggtgagcaggatcgccagatcaatgtcgatggtggccggttcaaagatacccgccagaatatcattacgctgccattcgccgaactggagttcgcgtttggccggatagcgccaggggatgatgtcatcgtgcaccacaatcgtcacctcaaccgcgcgcaggatttcgctctcgccgggggaggcggacgtttccagaaggtcgttgataagcgcgcggcgcgtggtctcgtcgagacggacggtaacggtgacaagcaggtcgatgtccgaatggggcttaaggccgccgtcaacggcgctaccatacagatgcacggcgaggagggtcggttcgaggtggcgctcgatgacacccacgacttccgacagctgggtggacacctcggcgatgaccgcttcacccatgatgtttaactttgttttagggcgactgccctgctgcgtaacatcgttgctgctccataacatcaaacatcgacccacggcgtaacgcgcttgctgcttggatgcccgaggcatagactgtaccccaaaaaaacagtcataacaagccatgaaaaccgccactgcgttccatgaatattcaaacaaacacatacagcgcgacttatcatggata

SEQ ID NO: 6 - DNA, 30687 bp, Artificial Sequence
  plasmid
ttgacatacaaatggacgaacggataaaccttttcacgcccttttaaatatccgattattctaataaacgctcttttctcttaggtttacccgccaatatatcctgtcaaacactgatagtttaaactgaaggcgggaaacgacaatctgatcactgattagtaactaaggcctttaattaatctagaggcgcgccgggccccctgcagggagctcggccggccaatttaaattgatatcggtacatcgattacgccaagctatcaactttgtatagaaaagttgccatgattacgccaagcttggccactaaggccaatttaaatctactaggccggccacacgggcaggacatagggactactacaagcatagtatgcttcagacaaagagctaggaaagaactcttgatggaggttaagagaaaaaagtgctagaggggcatagtaatcaaacttgtcaaaaccgtcatcatgatgagggatgacataatataaaaagttgactaaggtcttggtagtactctttgattagtattatatattggtgagaacatgagtcaagaggagacaagaaaccgaggaaccatagtttagcaacaagatggaagttgcaaagttgagctagccgctcgattagttacatctcctaagcagtactacaaggaatggtctctatactttcatgtttagcacatggtagtgcggattgacaagttagaaacagtgcttaggagacaaagagtcagtaaaggtattgaaagagtgaagttgatgctcgacaggtcaggagaagtccctccgccagatggtgactaccaaggggttggtatcagctgagacccaaataagattcttcggttgaaccagtggttcgaccgagactcttagggtgggatttcactgtaagatttgtgcattttgttgaatataaattgacaattttttttatttaattatagattatttagaatgaattacatatttagtttctaacaaggatagcaatggatgggtatgggtacaggttaaacatatctattacccacccatctagtcgtcgggttttacacgtacccacccgtttacataaaccagaccggaattttaaaccgtacccgtccgttagcgggtttcagatttacccgtttaatcgggtaaaacctgattactaaatatatattttttatttgataaacaaaacaaaaatgttaatattttcatattggatgcaattttaagaaacacatattcataaatttccatatttgtaggaaaataaaaagaaaaatatattcaagaacacaaatttcaccgacatgacttttattacagagttggaattagatctaacaattgaaaaattaaaattaagatagaatatgttgaggaacatgacatagtataatgctgggttacccgtcgggtaggtatcgaggcggatactactaaatccatcccactcgctatccgataatcactggtttcgggtatacccattcccgtcaacaggcctttttaaccggataatttcaacttatagtgaatgaattttgaataaatagttagaataccaaaatcctggattgcatttgcaatcaaattttgtgaaccgttaaattttgcatgtacttgggatagatataatagaaccgaattttcattagtttaatttataacttactttgttcaaagaaaaaaaatatctatccaatttacttataataaaaaataatctatccaagttacttattataatcaacttgtaaaaaggtaagaatacaaatgtggtagcgtacgtgtgattatatgtgacgaaatgttatatctaacaaaagtccaaattcccatggtaaaaaaaatcaaaatgcatggcaggctgtttgtaaccttggaataagatgttggccaattctggagccgccacgtacgcaagactcagggccacgttctcttcatgcaaggatagtagaacaccactccacccacctcctatattagacctttgcccaaccctccccaactttcccatcccatccacaaagaaaccgacatttttatcataaatcagggtttcgtttttgtttcatcgataaactcaaaggtgatgattttagggtcttgtgagtgtgcttttttgtttgattctactgtagggtttatgttctttagctcataggttttgtgtatttcttagaaatgtggcttctttaatctctgggtttgtgactttttgtgtggtttctgtgtttttcatatcaaaaacctattttttccgagtttttttttacaaattcttactctcaagcttgaatacttcacatgcagtgttcttttgtagattttagagttaatgtgttaaaaagtttggatttttcttgcttatagagcttcttcactttgattttgtgggtttttttgttttaaaggtgagatttttgatgaggtttttgcttcaaagatgtcacctttctgggtttgtcttttgaataaagctatgaactgtcacatggctgacgcaattttgttactatgtcatgaaagctgacgtttttccgtgttatacatgtttgcttacacttgcatgcgtcaaaaaaattggggctttttagttttagtcaaagattttacttctcttttgggatttatgaaggaaagttgcaaactttctcaaattttaccatttttgctttgatgtttgtttagattgcgacagaacaaactcatatatgttgaaatttttgcttggttttgtataggattgtgtcttttgcttataaatgttgaaatctgaactttttttttgtttggtttctttgagcaggagataaggcgcgccaccatggcttctacatctgctgctcaagacgctgctccttacgagttcccttctctcactgagatcaagagggctcttccttctgagtgtttcgaggcttctgttcctctttctctctactacaccgctagatctcttgctcttgctggatctctcgctgttgctctctcttacgctagagctttgcctcttgttcaggctaacgctcttcttgatgctactctctgcactggatacgttcttctccagggaatcgttttctggggattcttcaccgttggtcacgattgtggacacggagctttctctagatctcacgtgctcaacttctctgttggaaccctcatgcactctatcatccttacccctttcgagtcttggaagctctctcacagacaccaccacaagaacaccggaaacatcgataaggacgagatcttctaccctcaaagagaggctgattctcaccctgtttctagacaccttgtgatgtctcttggatctgcttggttcgcttaccttttcgctggattccctcctagaaccatgaaccacttcaacccttgggaggctatgtatgttagaagagtggctgctgtgatcatctctctcggagttcttttcgctttcgctggactctactcttacctcaccttcgttcttggattcaccactatggctatctactacttcggacctctcttcatcttcgctaccatgcttgttgttaccactttcctccaccacaacgatgaggagacaccttggtacgctgattctgagtggacttacgtgaagggaaacctctcttctgtggacagatcttacggtgctctcatcgacaaccttagccacaacatcggaactcaccagatccaccacctcttccctatcatccctcactacaagctcaacgatgctactgctgctttcgctaaggctttccctgagcttgttaggaaaaacgctgctcctatcatcccaactttcttcaggatggctgctatgtacgctaagtacggagttgttgacactgatgctaagaccttcactctcaaggaggctaaggctgctgctaagactaagtcatcttgatgattaattaaggccgcagatatcagatctggtcgacctagaggatccccggccgcaaagataataacaaaagcctactatataacgtacatgcaagtattgtatgatattaatgtttttacgtacgtgtaaacaaaaataattacgtttgtaacgtatggtgatgatgtggtgcactaggtgtaggccttgtattaataaaaagaagtttgttctatatagagtggtttagtacgacgatttatttactagtcggattggaatagagaaccgaattcttcaatccttgcttttgatcaagaattgaaaccgaatcaaatgtaaaagttgatatatttgaaaaacgtattgagcttatgaaaatgctaatactctcatctgtatggaaaagtgactttaaaaccgaacttaaaagtgacaaaaggggaatatcgcatcaaaccgaatgaaaccgatggcgcctactaccggtaattcccgggattagcggccgctagtctgtgcgcacttgtatcctgcaggttaggccggccattagcagatatttggtgtctaaatgtttattttgtgatatgttcatgtttgaaatggtggtttcgaaaccagggacaacgttgggatctgatagggtgtcaaagagtattatggattgggacaatttcggtcatgagttgcaaattcaagtatatcgttcgattatgaaaattttcgaagaatatcccatttgagagagtctttacctcattaatgtttttagattatgaaattttatcatagttcatcgtagtctttttggtgtaaaggctgtaaaaagaaattgttcacttttgttttcgtttatgtgaaggctgtaaaagattgtaaaagactattttggtgttttggataaaatgatagtttttatagattcttttgcttttagaagaaatacatttgaaattttttccatgttgagtataaaataccgaaatcgattgaagatcatagaaatattttaactgaaaacaaatttataactgattcaattctctccatttttatacctatttaaccgtaatcgattctaatagatgatcgattttttatataatcctaattaaccaacggcatgtattggataattaaccgatcaactctcacccctaatagaatcagtattttccttcgacgttaattgatcctacactatgtaggtcatatccatcgttttaatttttggccaccattcaattctgtcttgcctttagggatgtgaatatgaacggccaaggtaagagaataaaaataatccaaattaaagcaagagaggccaagtaagataatccaaatgtacacttgtcattgccaaaattagtaaaatactcggcatattgtattcccacacattattaaaataccgtatatgtattggctgcatttgcatgaataatactacgtgtaagcccaaaagaacccacgtgtagcccatgcaaagttaacactcacgaccccattcctcagtctccactatataaacccaccatccccaatctcaccaaacccaccacacaactcacaactcactctcacaccttaaagaaccaatcaccaccaaaaaatttcacgatttggaatttgattcctgcgatcacaggtatgacaggttagattttgttttgtatagttgtatacatacttctttgtgatgttttgtttacttaatcgaatttttggagtgttttaaggtctctcgtttagaaatcgtggaaaatatcactgtgtgtgtgttcttatgattcacagtgtttatgggtttcatgttctttgttttatcattgaatgggaagaaatttcgttgggatacaaatttctcatgttcttactgatcgttattaggagtttggggaaaaaggaagagtttttttggttggttcgagtgattatgaggttatttctgtatttgatttatgagttaatggtcgttttaatgttgtagaccatgggaaaaggatctgagggaagatctgctgctagagagatgactgctgaggctaacggagataagagaaagaccatcctcattgagggagtgttgtacgatgctaccaacttcaaacacccaggaggttccattattaacttcctcaccgagggagaagctggagttgatgctacccaagcttacagagagttccatcagagatccggaaaggctgataagtacctcaagtccctcccaaagttggatgcttctaaggtggagtctaggttctctgctaaggagcaggctagaagggacgctatgaccagggattacgctgctttcagagaggagttggttgctgagggatacttcgatccatctatcccacacatgatctacagagtggtggagattgtggctttgttcgctttgtctttctggttgatgtctaaggcttctccaacctctttggttttgggagtggtgatgaacggaatcgctcaaggaagatgcggatgggttatgcacgagatgggacacggatctttcactggagttatctggctcgatgataggatgtgcgagttcttctacggagttggatgtggaatgtctggacactactggaagaaccagcactctaagcaccacgctgctccaaacagattggagcacgatgtggatttgaacaccttgccactcgttgctttcaacgagagagttgtgaggaaggttaagccaggatctttgttggctttgtggctcagagttcaggcttatttgttcgctccagtgtcttgcttgttgatcggattgggatggaccttgtacttgcacccaagatatatgctcaggaccaagagacacatggagtttgtgtggatcttcgctagatatatcggatggttctccttgatgggagctttgggatattctcctggaacttctgtgggaatgtacctctgctctttcggacttggatgcatctacatcttcctccaattcgctgtgtctcacacccacttgccagttaccaacccagaggatcaattgcactggcttgagtacgctgctgatcacaccgtgaacatctctaccaagtcttggttggttacctggtggatgtctaacctcaacttccaaatcgagcaccacttgttcccaaccgctccacaattcaggttcaaggagatctctccaagagttgaggctctcttcaagagacacaacctcccttactacgatttgccatacacctctgctgtttctactaccttcgctaacctctactctgttggacactctgttggagctgataccaagaagcaggattgactgctttaatgagatatgcgagacgcctatgatcgcatgatatttgctttcaattctgttgtgcacgttgtaaaaaacctgagcatgtgtagctcagatccttaccgccggtttcggttcattctaatgaatatatcacccgttactatcgtatttttatgaataatattctccgttcaatttactgattgtgtcgacgcgatcgcgtgcaaacactgtacggaccgtggcctaataggccggtacccaagtttgtacaaaaaagcaggctccatgattacgccaagcttggccactaaggccaatttaaatctactaggccggccatcgacggcccggactgtatccaacttctgatctttgaatctctctgttccaacatgttctgaaggagttctaagacttttcagaaagcttgtaacatgctttgtagactttctttgaattactcttgcaaactctgattgaacctacgtgaaaactgctccagaagttctaaccaaattccgtcttgggaaggcccaaaatttattgagtacttcagtttcatggacgtgtcttcaaagatttataacttgaaatcccatcatttttaagagaagttctgttccgcaatgtcttagatctcattgaaatctacaactcttgtgtcagaagttcttccagaatcaacttgcatcatggtgaaaatctggccagaagttctgaacttgtcatatttcttaacagttagaaaaatttctaagtgtttagaattttgacttttccaaagcaaacttgacttttgactttcttaataaaacaaacttcatattctaacatgtcttgatgaaatgtgattcttgaaatttgatgttgatgcaaaagtcaaagtttgacttttcagtgtgcaattgaccattttgctcttgtgccaattccaaacctaaattgatgtatcagtgctgcaaacttgatgtcatggaagatcttatgagaaaattcttgaagactgagaggaaaaattttgtagtacaacacaaagaatcctgtttttcatagtcggactagacacattaacataaaacaccacttcattcgaagagtgattgaagaaggaaatgtgcagttacctttctgcagttcataagagcaacttacagacacttttactaaaatactacaaagaggaagattttaacaacttagagaagtaatgggagttaaagagcaacacattaagggggagtgttaaaattaatgtgttgtaaccaccactacctttagtaagtattataagaaaattgtaatcatcacattataattattgtccttatttaaaattatgataaagttgtatcattaagattgagaaaaccaaatagtcctcgtcttgatttttgaattattgttttctatgttacttttcttcaagcctatataaaaactttgtaatgctaaattgtatgctggaaaaaaatgtgtaatgaattgaatagaaattatggtatttcaaagtccaaaatccatcaatagaaatttagtacaaaacgtaactcaaaaatattctcttattttaaattttacaacaatataaaaatattctcttattttaaattttacaataatataatttatcacctgtcacctttagaataccaccaacaatattaatacttagatattttattcttaataattttgagatctctcaatatatctgatatttattttatatttgtgtcatattttcttatgttttagagttaacccttatatcttggtcaaactagtaattcaatatatgagtttgtgaaggacacattgacatcttgaaacattggttttaaccttgttggaatgttaaaggtaataaaacattcagaattatgaccatctattaatatacttcctttgtcttttaaaaaagtgtgcatgaaaatgctctatggtaagctagagtgtcttgctggcctgtgtatatcaattccatttccagatggtagaaactgccactacgaataattagtcataagacacgtatgttaacacacgtccccttgcatgttttttgccatatattccgtctctttctttttcttcacgtataaaacaatgaactaattaatagagcgatcaagctgaacagttctttgctttcgaagttgccgcaacctaaacaggtttttccttcttctttcttcttattaactacgaccttgtcctttgcctatgtaaaattactaggttttcatcagttacactgattaagttcgttatagtggaagataaaatgccctcaaagcattttgcaggatatctttgatttttcaaagatatggaactgtagagtttgatagtgttcttgaatgtggttgcatgaagtttttttggtctgcatgttattttttcctcgaaatatgttttgagtccaacaagtgattcacttgggattcagaaagttgttttctcaatatgtaacagtttttttctatggagaaaaatcatagggaccgttggttttggcttctttaattttgagctcagattaaacccattttacccggtgttcttggcagaattgaaaacagtacgtagtaccgcgcctaccatgtgtgttgagaccgagaacaacgatggaatccctactgtggagatcgctttcgatggagagagagaaagagctgaggctaacgtgaagttgtctgctgagaagatggaacctgctgctttggctaagaccttcgctagaagatacgtggttatcgagggagttgagtacgatgtgaccgatttcaaacatcctggaggaaccgtgattttctacgctctctctaacactggagctgatgctactgaggctttcaaggagttccaccacagatctagaaaggctaggaaggctttggctgctttgccttctagacctgctaagaccgctaaagtggatgatgctgagatgctccaggatttcgctaagtggagaaaggagttggagagggacggattcttcaagccttctcctgctcatgttgcttacagattcgctgagttggctgctatgtacgctttgggaacctacttgatgtacgctagatacgttgtgtcctctgtgttggtttacgcttgcttcttcggagctagatgtggatgggttcaacacgagggaggacactcttctttgaccggaaacatctggtgggataagagaatccaagctttcactgctggattcggattggctggatctggagatatgtggaactccatgcacaacaagcaccacgctactcctcaaaaagtgaggcacgatatggatttggataccactcctgctgttgctttcttcaacaccgctgtggaggataatagacctaggggattctctaagtactggctcagattgcaagcttggaccttcattcctgtgacttctggattggtgttgctcttctggatgttcttcctccacccttctaaggctttgaagggaggaaagtacgaggagcttgtgtggatgttggctgctcacgtgattagaacctggaccattaaggctgttactggattcaccgctatgcaatcctacggactcttcttggctacttcttgggtttccggatgctacttgttcgctcacttctctacttctcacacccacttggatgttgttcctgctgatgagcacttgtcttgggttaggtacgctgtggatcacaccattgatatcgatccttctcagggatgggttaactggttgatgggatacttgaactgccaagtgattcaccacctcttcccttctatgcctcaattcagacaacctgaggtgtccagaagattcgttgctttcgctaagaagtggaacctcaactacaaggtgatgacttatgctggagcttggaaggctactttgggaaacctcgataatgtgggaaagcactactacgtgcacggacaacactctggaaagaccgcttgattaattaaggccgcctcgaccgtaccccctgcagatagactatactatgttttagcctgcctgctggctagctactatgttatgttatgttgtaaaataaacacctgctaaggtatatctatctatattttagcatggctttctcaataaattgtctttccttatcgtttactatcttatacctaataatgaaataataatatcacatatgaggaacggggcaggtttaggcatatatatacgagtgtagggcggagtggggggcgcctactaccggtaattcccgggattagcggccgctagtctgtgcgcacttgtatcctgcaggttaggccggccaaagctttacaacgctacacaaaacttataaccgtaatcaccattcattaacttaactactatcacatgcattcatgaattgaaacgagaaggatgtaaatagttgggaagttatctccacgttgaagagatcgttagcgagagctgaaagaccgagggaggagacgccgtcaacacggacagagtcgtcgaccctcacatgaagtaggaggaatctccgtgaggagccagagagacgtctttggtcttcggtttcgatccttgatctgacggagaagacgagagaagtgcgactggactccgtgaggaccaacagagtcgtcctcggtttcgatcgtcggtattggtggagaaggcggaggaatctccgtgacgagccagagagatgtcgtcggtcttcggtttcgatccttgatctgacggagaagacgagagaagtgcgacgagactccgtgaggaccaacagagttgtcctcggtttcgatcgtcggtttcggcggagaaggcggaggaatctccgtgaggagccagagagacgtcgttggtcttcggtttcgatccttgatctgttggagaagacgagacaagtgggacgagactcaacgacggagtcagagacgtcgtcggtcttcggtttcggccgagaaggcggagtcggtcttcggtttcggccgagaaggcggaggagacgtcttcgatttgggtctctcctcttgacgaagaaaacaaagaacacgagaaataatgagaaagagaacaaaagaaaaaaaaataaaaataaaaataaaatttggtcctcttatgtggtgacacgtggtttgaaacccaccaaataatcgatcacaaaaaacctaagttaaggatcggtaataacctttctaattaattttgatttatattaaatcactctttttatttataaaccccactaaattatgcgatattgattgtctaagtacaaaaattctctcgaattcaatacacatgtttcatatatttagccctgttcatttaatattactagcgcatttttaatttaaaattttgtaaacttttttggtcaaagaacatttttttaattagagacagaaatctagactctttatttggaataatagtaataaagatatattaggcaatgagtttatgatgttatgtttatatagtttatttcattttaaattgaaaagcattatttttatcgaaatgaatctagtatacaatcaatatttatgttttttcatcagatactttcctattttttggcacctttcatcggactactgatttatttcaatgtgtatgcatgcatgagcatgagtatacacatgtcttttaaaatgcatgtaaagcgtaacggaccacaaaagaggatccatacaaatacatctcatcgcttcctctactattctccgacacacacactgagcatggtgcttaaacactctggtgagttctagtacttctgctatgatcgatctcattaccatttcttaaatttctctccctaaatattccgagttcttgatttttgataacttcaggttttctctttttgataaatctggtctttccatttttttttttttgtggttaatttagtttcctatgttcttcgattgtattatgcatgatctgtgtttggattctgttagattatgtattggtgaatatgtatgtgtttttgcatgtctggttttggtcttaaaaatgttcaaatctgatgatttgattgaagcttttttagtgttggtttgattcttctcaaaactactgttaatttactatcatgttttccaactttgattcatgatgacacttttgttctgctttgttataaaattttggttggtttgattttgtaattatagtgtaattttgttaggaatgaacatgttttaatactctgttttcgatttgtcacacattcgaattattaatcgataatttaactgaaaattcatggttctagatcttgttgtcatcagattatttgtttcgataattcatcaaatatgtagtccttttgctgatttgcgactgtttcattttttctcaaaattgttttttgttaagtttatctaacagttatcgttgtcaaaagtctctttcattttgcaaaatcttctttttttttttgtttgtaactttgttttttaagctacacatttagtctgtaaaatagcatcgaggaacagttgtcttagtagacttgcatgttcttgtaacttctatttgtttcagtttgttgatgactgctttgattttgtaggtcaaaccatggatgcttataacgctgctatggataagattggagctgctatcatcgattggagtgatccagatggaaagttcagagctgatagggaggattggtggttgtgcgatttcagatccgctatcaccattgctctcatctacatcgctttcgtgatcttgggatctgctgtgatgcaatctctcccagctatggacccataccctatcaagttcctctacaacgtgtctcaaatcttcctctgcgcttacatgactgttgaggctggattcctcgcttataggaacggatacaccgttatgccatgcaaccacttcaacgtgaacgatccaccagttgctaacttgctctggctcttctacatctccaaagtgtgggatttctgggataccatcttcattgtgctcggaaagaagtggagacaactctctttcttgcacgtgtaccaccacaccaccatcttcctcttctactggttgaacgctaacgtgctctacgatggagatatcttcttgaccatcctcctcaacggattcattcacaccgtgatgtacacctactacttcatctgcatgcacaccaaggattctaagaccggaaagtctttgccaatctggtggaagtcatctttgaccgctttccaactcttgcaattcaccatcatgatgtcccaagctacctacttggttttccacggatgcgataaggtttccctcagaatcaccatcgtgtacttcgtgtacattctctcccttttcttcctcttcgctcagttcttcgtgcaatcctacatggctccaaagaagaagaagtccgcttgatgttaattaactaagtttgatgtatctgagtgccaacgtttactttgtctttcctttcttttattggttatgattagatgtttactatgttctctctttttcgttataaataaagaagttcaattcttctatagtttcaaacgcgattttaagcgtttctatttaggtttacatgatttcttttacaaaatcatctttaaaatacagtatatttttagttttcataaaatatttaaagaaatgaaagtttataaacattcactcctattctctaattaaggatttgtaaaacaaaaattttgtaagcatatcgatttatgcgttttgtcttaattagctcactaaataataaataatagcttatgttgtgggactgtttaattacctaacttagaactaaaatcaactctttgtgggcaaacactgtacggaccgtggcctaataggccggtaccacccagctttcttgtacaaagtggccatgattacgccaagcttggccactaaggccaatttaaatctactaggccggccataaggatgacctacccattcttgagacaaatgttacattttagtatcagagtaaaatgtgtacctataactcaaattcgattgacatgtatccattcaacataaaattaaaccagcctgcacctgcatccacatttcaagtattttcaaaccgttcggctcctatccaccgggtgtaacaagacggattccgaatttggaagattttgactcaaattcccaatttatattgaccgtgactaaatcaactttaacttctataattctgattaagctcccaatttatattcccaacggcactacctccaaaatttatagactctcatccccttttaaaccaacttagtaaacgttttttttttaattttatgaagttaagtttttaccttgtttttaaaaagaatcgttcataagatgccatgccagaacattagctacacgttacacatagcatgcagccgcggagaattgtttttcttcgccacttgtcactcccttcaaacacctaagagcttctctctcacagcacacacatacaatcacatgcgtgcatgcattattacacgtgatcgccatgcaaatctcctttatagcctataaattaactcatcggcttcactctttactcaaaccaaaactcatcaatacaaacaagattaaaaacatttcacgatttggaatttgattcctgcgatcacaggtatgacaggttagattttgttttgtatagttgtatacatacttctttgtgatgttttgtttacttaatcgaatttttggagtgttttaaggtctctcgtttagaaatcgtggaaaatatcactgtgtgtgtgttcttatgattcacagtgtttatgggtttcatgttctttgttttatcattgaatgggaagaaatttcgttgggatacaaatttctcatgttcttactgatcgttattaggagtttggggaaaaaggaagagtttttttggttggttcgagtgattatgaggttatttctgtatttgatttatgagttaatggtcgttttaatgttgtagaccgccatggctattttgaaccctgaggctgattctgctgctaacctcgctactgattctgaggctaagcaaagacaattggctgaggctggatacactcatgttgagggtgctcctgctcctttgcctttggagttgcctcatttctctctcagagatctcagagctgctattcctaagcactgcttcgagagatctttcgtgacctccacctactacatgatcaagaacgtgttgacttgcgctgctttgttctacgctgctaccttcattgatagagctggagctgctgcttatgttttgtggcctgtgtactggttcttccagggatcttacttgactggagtgtgggttatcgctcatgagtgtggacatcaggcttattgctcttctgaggtggtgaacaacttgattggactcgtgttgcattctgctttgttggtgccttaccactcttggagaatctctcacagaaagcaccattccaacactggatcttgcgagaacgatgaggttttcgttcctgtgaccagatctgtgttggcttcttcttggaacgagaccttggaggattctcctctctaccaactctaccgtatcgtgtacatgttggttgttggatggatgcctggatacctcttcttcaacgctactggacctactaagtactggggaaagtctaggtctcacttcaacccttactccgctatctatgctgatagggagagatggatgatcgtgctctccgatattttcttggtggctatgttggctgttttggctgctttggtgcacactttctccttcaacaccatggtgaagttctacgtggtgccttacttcattgtgaacgcttacttggtgttgattacctacctccaacacaccgatacctacatccctcatttcagagagggagagtggaattggttgagaggagctttgtgcactgtggatagatcatttggtccattcctcgattctgtggtgcatagaatcgtggatacccatgtttgccaccacatcttctccaagatgcctttctatcattgcgaggaggctaccaacgctattaagcctctcctcggaaagttctacttgaaggataccactcctgttcctgttgctctctggagatcttacacccattgcaagttcgttgaggatgatggaaaggtggtgttctacaagaacaagctctagttaattaataattgattggttcgagtattatggcattgggaaaactgtttttcttgtaccatttgttgtgcttgtaatttactgtgttttttattcggttttcgctatcgaactgtgaaatggaaatggatggagaagagttaatgaatgatatggtccttttgttcattctcaaattaatattatttgttttttctcttatttgttgtgtgttgaatttgaaattataagagatatgcaaacattttgttttgagtaaaaatgtgtcaaatcgtggcctctaatgaccgaagttaatatgaggagtaaaacacttgtagttgtaccattatgcttattcactaggcaacaaatatattttcagacctagaaaagctgcaaatgttactgaatacaagtatgtcctcttgtgttttagacatttatgaactttcctttatgtaattttccagaatccttgtcagattctaatcattgctttataattatagttatactcatggatttgtagttgagtatgaaaatattttttaatgcattttatgacttgccaattgattgacaacatgcatcaatggcgcctactaccggtaattcccgggattagcggccgctagtctgtgcgcacttgtatcctgcaggttaggccggccactgcagcaaatttacacattgccactaaacgtctaaacccttgtaatttgtttttgttttactatgtgtgttatgtatttgatttgcgataaatttttatatttggtactaaatttataacaccttttatgctaacgtttgccaacacttagcaatttgcaagttgattaattgattctaaattatttttgtcttctaaatacatatactaatcaactggaaatgtaaatatttgctaatatttctactataggagaattaaagtgagtgaatatggtaccacaaggtttggagatttaattgttgcaatgctgcatggatggcatatacaccaaacattcaataattcttgaggataataatggtaccacacaagatttgaggtgcatgaacgtcacgtggacaaaaggtttagtaatttttcaagacaacaatgttaccacacacaagttttgaggtgcatgcatggatgccctgtggaaagtttaaaaatattttggaaatgatttgcatggaagccatgtgtaaaaccatgacatccacttggaggatgcaataatgaagaaaactacaaatttacatgcaactagttatgcatgtagtctatataatgaggattttgcaatactttcattcatacacactcactaagttttacacgattataatttcttcatagccagtactgtttaagcttcactgtctctgaatcggcaaaggtaaacgtatcaattattctacaaacccttttatttttcttttgaattaccgtcttcattggttatatgataacttgataagtaaagcttcaataattgaatttgatctgtgtttttttggccttaatactaaatccttacataagctttgttgcttctcctcttgtgagttgagtgttaagttgtaataatggttcactttcagctttagaagaaacgcgccttccatggctacaaaggaggcttacgttttcccaactctcaccgagatcaagagatctctcccaaaggattgcttcgaggcttctgtgcctttgtctctctactacactgtgagatgcttggttattgctgtggctttgaccttcggattgaactacgctagagctttgccagaggttgagtctttctgggctttggatgctgctttgtgcactggatatatcctcctccagggaattgtgttctggggattcttcactgttggacacgatgctggacacggagctttctctagataccacctcttgaacttcgttgtgggaaccttcatgcactctctcatcttgaccccattcgagtcttggaagttgacccacagacaccaccacaagaacaccggaaacatcgatagagatgaggtgttctacccacagagaaaggctgatgatcacccattgtccaggaacttgatcttggctttgggagctgcttggcttgcttatttggtggagggattcccaccaagaaaggtgaaccacttcaacccattcgagccactttttgtgagacaagtgtccgctgtggttatctctttgctcgctcacttcttcgttgctggactctctatctacttgtctctccagttgggacttaagaccatggctatctactactacggaccagttttcgtgttcggatctatgttggtgattaccaccttcttgcaccacaacgatgaggagactccatggtatgctgattctgagtggacttacgtgaagggaaacttgtcctctgtggatagatcttacggtgctctcatcgataacctctcccacaacatcggaactcaccagatccaccacctcttcccaattatcccacactacaagctcaagaaggctactgctgctttccaccaagctttcccagagcttgtgagaaagtccgatgagccaatcatcaaggctttcttcagagtgggaaggttgtatgctaactacggagtggttgatcaagaggctaagctcttcactttgaaggaggctaaggctgctactgaagctgctgctaagaccaagtctacctgattaattaatcgacaagctcgagtttctccataataatgtgtgagtagttcccagataagggaattagggttcctatagggtttcgctcatgtgttgagcatataagaaacccttagtatgtatttgtatttgtaaaatacttctatcaataaaatttctaattcctaaaaccaaaatccagtactaaaatccagatcccccgaattaattcggcgttaattcagggcaaacactgtacggaccgtggcctaataggccggtacccaactttattatacatagttgataattcactggccggatgtaccgaattcgcggccgcaagcttgtacactagtacgcgtcaattggcgatcgcggatctgagatgaaaccggtgattatcagaaccttttatggtctttgtatgcatatggtaaaaaaacttagtttgcaatttcctgtttgttttggtaatttgagtttcttttagttgttgatctgcctgctttttggtttacgtcagactactactgctgttgttgtttggtttcctttctttcattttataaataaataatccggttcggtttactccttgtgactggctcagtttggttattgcgaaatgcgaatggtaaattgagtaattgaaattcgttattagggttctaagctgttttaacagtcactgggttaatatctctcgaatcttgcatggaaaatgctcttaccattggtttttaattgaaatgtgctcatatgggccgtggtttccaaattaaataaaactacgatgtcatcgagaagtaaaatcaactgtgtccacattatcagttttgtgtatacgatgaaatagggtaattcaaaatctagcttgatatgccttttggttcattttaaccttctgtaaacattttttcagattttgaacaagtaaatccaaaaaaaaaaaaaaaaaatctcaactcaacactaaattattttaatgtataaaagatgcttaaaacatttggcttaaaagaaagaagctaaaaacatagagaactcttgtaaattgaagtatgaaaatatactgaattgggtattatatgaatttttctgatttaggattcacatgatccaaaaaggaaatccagaagcactaatcagacattggaagtaggaatatttcaaaaagttttttttttttaagtaagtgacaaaagcttttaaaaaatagaaaagaaactagtattaaagttgtaaatttaataaacaaaagaaattttttatattttttcatttctttttccagcatgaggttatgatggcaggatgtggatttcatttttttccttttgatagccttttaattgatctattataattgacgaaaaaatattagttaattatagatatattttaggtagtattagcaatttacacttccaaaagactatgtaagttgtaaatatgatgcgttgatctcttcatcattcaatggttagtcaaaaaaataaaagcttaactagtaaactaaagtagtcaaaaattgtactttagtttaaaatattacatgaataatccaaaacgacatttatgtgaaacaaaaacaatatagatccattaccctgttatccctagaggggaaaattcgaatccaaaaattacggatatgaatataggcatatccgtatccgaattatccgtttgacagctagcaacgattgtacaattgcttctttaaaaaaggaagaaagaaagaaagaaaagaatcaacatcagcgttaacaaacggccccgttacggcccaaacggtcatatagagtaacggcgttaagcgttgaaagactcctatcgaaatacgtaaccgcaaacgtgtcatagtcagatcccctcttccttcaccgcctcaaacacaaaaataatcttctacagcctatatatacaacccccccttctatctctcctttctcacaattcatcatctttctttctctacccccaattttaagaaatcctctcttctcctcttcattttcaaggtaaatctctctctctctctctctctctgttattccttgttttaattaggtatgtattattgctagtttgttaatctgcttatcttatgtatgccttatgtgaatatctttatcttgttcatctcatccgtttagaagctataaatttgttgatttgactgtgtatctacacgtggttatgtttatatctaatcagatatgaatttcttcatattgttgcgtttgtgtgtaccaatccgaaatcgttgatttttttcatttaatcgtgtagctaattgtacgtatacatatggatctacgtatcaattgttcatctgtttgtgtttgtatgtatacagatctgaaaacatcacttctctcatctgattgtgttgttacatacatagatatagatctgttatatcattttttttattaattgtgtatatatatatgtgcatagatctggattacatgattgtgattatttacatgattttgttatttacgtatgtatatatgtagatctggactttttggagttgttgacttgattgtatttgtgtgtgtatatgtgtgttctgatcttgatatgttatgtatgtgcagctgaaccatggcggcggcaacaacaacaacaacaacatcttcttcgatctccttctccaccaaaccatctccttcctcctccaaatcaccattaccaatctccagattctccctcccattctccctaaaccccaacaaatcatcctcctcctcccgccgccgcggtatcaaatccagctctccctcctccatctccgccgtgctcaacacaaccaccaatgtcacaaccactccctctccaaccaaacctaccaaacccgaaacattcatctcccgattcgctccagatcaaccccgcaaaggcgctgatatcctcgtcgaagctttagaacgtcaaggcgtagaaaccgtattcgcttaccctggaggtacatcaatggagattcaccaagccttaacccgctcttcctcaatccgtaacgtccttcctcgtcacgaacaaggaggtgtattcgcagcagaaggatacgctcgatcctcaggtaaaccaggtatctgtatagccacttcaggtcccggagctacaaatctcgttagcggattagccgatgcgttgttagatagtgttcctcttgtagcaatcacaggacaagtccctcgtcgtatgattggtacagatgcgtttcaagagactccgattgttgaggtaacgcgttcgattacgaagcataactatcttgtgatggatgttgaagatatccctaggattattgaggaagctttctttttagctacttctggtagacctggacctgttttggttgatgttcctaaagatattcaacaacagcttgcgattcctaattgggaacaggctatgagattacctggttatatgtctaggatgcctaaacctccggaagattctcatttggagcagattgttaggttgatttctgagtctaagaagcctgtgttgtatgttggtggtggttgtttgaattctagcgatgaattgggtaggtttgttgagcttacggggatccctgttgcgagtacgttgatggggctgggatcttatccttgtgatgatgagttgtcgttacatatgcttggaatgcatgggactgtgtatgcaaattacgctgtggagcatagtgatttgttgttggcgtttggggtaaggtttgatgatcgtgtcacgggtaagcttgaggcttttgctagtagggctaagattgttcatattgatattgactcggctgagattgggaagaataagactcctcatgtgtctgtgtgtggtgatgttaagctggctttgcaagggatgaataaggttcttgagaaccgagcggaggagcttaagcttgattttggagtttggaggaatgagttgaacgtacagaaacagaagtttccgttgagctttaagacgtttggggaagctattcctccacagtatgcgattaaggtccttgatgagttgactgatggaaaagccataataagtactggtgtcgggcaacatcaaatgtgggcggcgcagttctacaattacaagaaaccaaggcagtggctatcatcaggaggccttggagctatgggatttggacttcctgctgcgattggagcgtctgttgctaaccctgatgcgatagttgtggatattgacggagatggaagctttataatgaatgtgcaagagctagccactattcgtgtagagaatcttccagtgaaggtacttttattaaacaaccagcatcttggcatggttatgcaatgggaagatcggttctacaaagctaaccgagctcacacatttctcggggatccggctcaggaggacgagatattcccgaacatgttgctgtttgcagcagcttgcgggattccagcggcgagggtgacaaagaaagcagatctccgagaagctattcagacaatgctggatacaccaggaccttacctgttggatgtgatttgtccgcaccaagaacatgtgttgccgatgatcccgaatggtggcactttcaacgatgtcataacggaaggagatggccggattaaatactgatagggataacagggtaatctcgacgagatgaaaccggtgattatcagaaccttttatggtctttgtatgcatatggtaaaaaaacttagtttgcaatttcctgtttgttttggtaatttgagtttcttttagttgttgatctgcctgctttttggtttacgtcagactactactgctgttgttgtttggtttcctttctttcattttataaataaataatccggttcggtttactccttgtgactggctcagtttggttattgcgaaatgcgaatggtaaattgagtaattgaaattcgttattagggttctaagctgttttaacagtcactgggttaatatctctcgaatcttgcatggaaaatgctcttaccattggtttttaattgaaatgtgctcatatgggccgtggtttccaaattaaataaaactacgatgtcatcgagaagtaaaatcaactgtgtccacattatcagttttgtgtatacgatgaaatagggtaattcaaaatctagcttgatatgccttttggttcattttaaccttctgtaaacattttttcagattttgaacaagtaaatccaaaaaaaaaaaaaaaaaatctcaactcaacactaaattattttaatgtataaaagatgcttaaaacatttggcttaaaagaaagaagctaaaaacatagagaactcttgtaaattgaagtatgaaaatatactgaattgggtattatatgaatttttctgatttaggattcacatgatccaaaaaggaaatccagaagcactaatcagacattggaagtaggaatatttcaaaaagttttttttttttaagtaagtgacaaaagcttttaaaaaatagaaaagaaactagtattaaagttgtaaatttaataaacaaaagaaattttttatattttttcatttctttttccagcatgaggttatgatggcaggatgtggatttcatttttttccttttgatagccttttaattgatctattataattgacgaaaaaatattagttaattatagatatattttaggtagtattagcaatttacacttccaaaagactatgtaagttgtaaatatgatgcgttgatctcttcatcattcaatggttagtcaaaaaaataaaagcttaactagtaaactaaagtagtcaaaaattgtactttagtttaaaatattacatgaataatccaaaacgacatttatgtgaaacaaaaacaatatgtcgaggcgatcgcagtacttaatcagtgatcagtaactaaattcagtacattaaagacgtccgcaatgtgttattaagttgtctaagcgtcaatttgtttacaccacaatatatcctgccaccagccagccaacagctccccgaccggcagctcggcacaaaatcactgatcatctaaaaaggtgatgtgtatttgagtaaaacagcttgcgtcatgcggtcgctgcgtatatgatgcgatgagtaaataaacaaatacgcaaggggaacgcatgaaggttatcgctgtacttaaccagaaaggcgggtcaggcaagacgaccatcgcaacccatctagcccgcgccctgcaactcgccggggccgatgttctgttagtcgattccgatccccagggcagtgcccgcgattgggcggccgtgcgggaagatcaaccgctaaccgttgtcggcatcgaccgcccgacgattgaccgcgacgtgaaggccatcggccggcgcgacttcgtagtgatcgacggagcgccccaggcggcggacttggctgtgtccgcgatcaaggcagccgacttcgtgctgattccggtgcagccaagcccttacgacatttgggccaccgccgacctggtggagctggttaagcagcgcattgaggtcacggatggaaggctacaagcggcctttgtcgtgtcgcgggcgatcaaaggcacgcgcatcggcggtgaggttgccgaggcgctggccgggtacgagctgcccattcttgagtcccgtatcacgcagcgcgtgagctacccaggcactgccgccgccggcacaaccgttcttgaatcagaacccgagggcgacgctgcccgcgaggtccaggcgctggccgctgaaattaaatcaaaactcatttgagttaatgaggtaaagagaaaatgagcaaaagcacaaacacgctaagtgccggccgtccgagcgcacgcagcagcaaggctgcaacgttggccagcctggcagacacgccagccatgaagcgggtcaactttcagttgccggcggaggatcacaccaagctgaagatgtacgcggtacgccaaggcaagaccattaccgagctgctatctgaatacatcgcgcagctaccagagtaaatgagcaaatgaataaatgagtagatgaattttagcggctaaaggaggcggcatggaaaatcaagaacaaccaggcaccgacgccgtggaatgccccatgtgtggaggaacgggcggttggccaggcgtaagcggctgggttgtctgccggccctgcaatggcactggaacccccaagcccgaggaatcggcgtgagcggtcgcaaaccatccggcccggtacaaatcggcgcggcgctgggtgatgacctggtggagaagttgaaggccgcgcaggccgcccagcggcaacgcatcgaggcagaagcacgccccggtgaatcgtggcaaggggccgctgatcgaatccgcaaagaatcccggcaaccgccggcagccggtgcgccgtcgattaggaagccgcccaagggcgacgagcaaccagattttttcgttccgatgctctatgacgtgggcacccgcgatagtcgcagcatcatggacgtggccgttttccgtctgtcgaagcgtgaccgacgagctggcgaggtgatccgctacgagcttccagacgggcacgtagaggtttccgcaggccccgccggcatggccagtgtgtgggattacgacctggtactgatggcggtttcccatctaaccgaatccatgaaccgataccgggaagggaagggagacaagcccggccgcgtgttccgtccacacgttgcggacgtactcaagttctgccggcgagccgatggcggaaagcagaaagacgacctggtagaaacctgcattcggttaaacaccacgcacgttgccatgcagcgtaccaagaaggccaagaacggccgcctggtgacggtatccgagggtgaagccttgattagccgctacaagatcgtaaagagcgaaaccgggcggccggagtacatcgagatcgagcttgctgattggatgtaccgcgagatcacagaaggcaagaacccggacgtgctgacggttcaccccgattactttttgatcgaccccggcatcggccgttttctctaccgcctggcacgccgcgccgcaggcaaggcagaagccagatggttgttcaagacgatctacgaacgcagtggcagcgccggagagttcaagaagttctgtttcaccgtgcgcaagctgatcgggtcaaatgacctgccggagtacgatttgaaggaggaggcggggcaggctggcccgatcctagtcatgcgctaccgcaacctgatcgagggcgaagcatccgccggttcctaatgtacggagcagatgctagggcaaattgccctagcaggggaaaaaggtcgaaaaggtctctttcctgtggatagcacgtacattgggaacccaaagccgtacattgggaaccggaacccgtacattgggaacccaaagccgtacattgggaaccggtcacacatgtaagtgactgatataaaagagaaaaaaggcgatttttccgcctaaaactctttaaaacttattaaaactcttaaaacccgcctggcctgtgcataactgtctggccagcgcacagccgaagagctgcaaaaagcgcctacccttcggtcgctgcgctccctacgccccgccgcttcgcgtcggcctatcgcggcctatgcggtgtgaaataccgcacagatgcgtaaggagaaaataccgcatcaggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtccttcaactcatcgatagtttggctgtgagcaattatgtgcttagtgcatctaacgcttgagttaagccgcgccgcgaagcggcgtcggcttgaacgaatttctagctagacattatttgccaacgaccttcgtgatctcgcccttgacatagtggacaaattcttcgagctggtcggcccgggacgcgagacggtcttcttcttggcccagataggcttggcgcgcttcgaggatcacgggctggtattgcgccggaaggcgctccatcgcccagtcggcggcgacatccttcggcgcgatcttgccggtaaccgccgagtaccaaatccggctcagcgtaaggaccacattgcgctcatcgcccgcccaatccggcggggagttccacagggtcagcgtctcgttcagtgcttcgaacagatcctgttccggcaccgggtcgaaaagttcctcggccgcggggccgacgagggccacgctatgctcccgggccttggtgagcaggatcgccagatcaatgtcgatggtggccggttcaaagatacccgccagaatatcattacgctgccattcgccgaactggagttcgcgtttggccggatagcgccaggggatgatgtcatcgtgcaccacaatcgtcacctcaaccgcgcgcaggatttcgctctcgccgggggaggcggacgtttccagaaggtcgttgataagcgcgcggcgcgtggtctcgtcgagacggacggtaacggtgacaagcaggtcgatgtccgaatggggcttaaggccgccgtcaacggcgctaccatacagatgcacggcgaggagggtcggttcgaggtggcgctcgatgacacccacgacttccgacagctgggtggacacctcggcgatgaccgcttcacccatgatgtttaactttgttttagggcgactgccctgctgcgtaacatcgttgctgctccataacatcaaacatcgacccacggcgtaacgcgcttgctgcttggatgcccgaggcatagactgtaccccaaaaaaacagtcataacaagccatgaaaaccgccactgcgttccatgaatattcaaacaaacacatacagcgcgacttatcatggata

SEQ ID NO: 7 - DNA, 24750 bp, Artificial Sequence
  plasmid
ttgacatacaaatggacgaacggataaaccttttcacgcccttttaaatatccgattattctaataaacgctcttttctcttaggtttacccgccaatatatcctgtcaaacactgatagtttaaactgaaggcgggaaacgacaatctgatcactgattagtaactaaggcctttaattaatctagaggcgcgccgggccccctgcagggagctcggccggccaatttaaattgatatcggtacatcgattacgccaagctatcaactttgtatagaaaagttgccatgattacgccaagcttggccactaaggccaatttaaatctactaggccggccattagcagatatttggtgtctaaatgtttattttgtgatatgttcatgtttgaaatggtggtttcgaaaccagggacaacgttgggatctgatagggtgtcaaagagtattatggattgggacaatttcggtcatgagttgcaaattcaagtatatcgttcgattatgaaaattttcgaagaatatcccatttgagagagtctttacctcattaatgtttttagattatgaaattttatcatagttcatcgtagtctttttggtgtaaaggctgtaaaaagaaattgttcacttttgttttcgtttatgtgaaggctgtaaaagattgtaaaagactattttggtgttttggataaaatgatagtttttatagattcttttgcttttagaagaaatacatttgaaattttttccatgttgagtataaaataccgaaatcgattgaagatcatagaaatattttaactgaaaacaaatttataactgattcaattctctccatttttatacctatttaaccgtaatcgattctaatagatgatcgattttttatataatcctaattaaccaacggcatgtattggataattaaccgatcaactctcacccctaatagaatcagtattttccttcgacgttaattgatcctacactatgtaggtcatatccatcgttttaatttttggccaccattcaattctgtcttgcctttagggatgtgaatatgaacggccaaggtaagagaataaaaataatccaaattaaagcaagagaggccaagtaagataatccaaatgtacacttgtcattgccaaaattagtaaaatactcggcatattgtattcccacacattattaaaataccgtatatgtattggctgcatttgcatgaataatactacgtgtaagcccaaaagaacccacgtgtagcccatgcaaagttaacactcacgaccccattcctcagtctccactatataaacccaccatccccaatctcaccaaacccaccacacaactcacaactcactctcacaccttaaagaaccaatcaccaccaaaaaaccgcgccaccatgcttgttcttttcggaaacttctacgtgaagcagtactctcaaaagaacggaaagcctgagaacggtgctactcctgaaaacggtgcaaagcctcaaccttgtgagaacggaactgttgagaagagggagaacgataccgctaatgttagacctactagaccagctggacctcctcctgctacttactacgattctctcgctgtttctggacagggaaaagagagacttttcaccaccgacgaagttagaaggcacatcctccctactgacggatggcttacttgtcacgagggagtttacgacgttactgacttccttgcaaaacaccctggtggaggtgttatcactcttggactcggaagagattgcactatcctcatcgagtcttaccaccctgctggtagacctgataaggtgatggaaaagtaccgtatcggaactcttcaagaccctaagactttctacgcttggggagagtctgatttctaccctgagcttaagagaagggctcttgctagacttaaagaggctggacaagctagaagaggtggacttggagttaaggctctccttgttcttactctcttcttcgtgtcttggtatatgtgggttgcacacaagtctttcttgtgggctgctgtttggggattcgctggatcacatgtgggactttctatccagcacgacggaaaccacggtgctttctctagaaacaccctcgttaacagacttgctggatggggaatggatcttatcggagcttcttctactgtttgggagtaccagcacgttatcggacaccaccagtacactaacctcgtttctgatacccttttcagccttcctgagaacgatcctgatgtgttctcttcttaccctctcatgagaatgcaccctgatactgcttggcaacctcaccacagattccagcaccttttcgctttccctttgttcgctctcatgaccatctctaaggttctcacctctgatttcgctgtttgcctctctatgaagaagggatctatcgattgctctagcagacttgttcctcttgagggacaacttcttttctggggtgctaaacttgctaacttcctcctccaaatcgttcttccttgttaccttcacggaactgctatgggacttgctcttttctctgttgctcaccttgtttctggtgagtaccttgctatctgcttcatcatcaaccacatctctgagtcttgtgagttcatgaacacctcattccaaactgctgctagaagaactgagatgcttcaagctgctcatcaagctgctgaggctaagaaggttaagcctactcctcctcctaacgattgggctgttactcaagttcagtgctgtgttaactggcgttctggtggagttcttgctaaccacctttctggtggacttaaccaccagatcgagcaccacctcttcccttctatctctcacgctaactaccctactatcgctcctgttgtgaaagaagtgtgcgaggaatacggacttccttacaagaactacgtgaccttctgggatgctgtttgtggaatggttcagcaccttagacttatgggtgctcctcctgttcctactaacggtgacaaaaaaagttgatgattaattaataattgattgctgctttaatgagatatgcgagacgcctatgatcgcatgatatttgctttcaattctgttgtgcacgttgtaaaaaacctgagcatgtgtagctcagatccttaccgccggtttcggttcattctaatgaatatatcacccgttactatcgtatttttatgaataatattctccgttcaatttactgattgtggcgcctactaccggtaattcccgggattagcggccgctagtctgtgcgcacttgtatcctgcaggtcaatcgtttaaacactgtacggaccgtggcctaataggccggtacccaagtttgtacaaaaaagcaggctccatgattacgccaagcttggccactaaggccaatttaaatctactaggccggccaaagctttacaacgctacacaaaacttataaccgtaatcaccattcattaacttaactactatcacatgcattcatgaattgaaacgagaaggatgtaaatagttgggaagttatctccacgttgaagagatcgttagcgagagctgaaagaccgagggaggagacgccgtcaacacggacagagtcgtcgaccctcacatgaagtaggaggaatctccgtgaggagccagagagacgtctttggtcttcggtttcgatccttgatctgacggagaagacgagagaagtgcgactggactccgtgaggaccaacagagtcgtcctcggtttcgatcgtcggtattggtggagaaggcggaggaatctccgtgacgagccagagagatgtcgtcggtcttcggtttcgatccttgatctgacggagaagacgagagaagtgcgacgagactccgtgaggaccaacagagttgtcctcggtttcgatcgtcggtttcggcggagaaggcggaggaatctccgtgaggagccagagagacgtcgttggtcttcggtttcgatccttgatctgttggagaagacgagacaagtgggacgagactcaacgacggagtcagagacgtcgtcggtcttcggtttcggccgagaaggcggagtcggtcttcggtttcggccgagaaggcggaggagacgtcttcgatttgggtctctcctcttgacgaagaaaacaaagaacacgagaaataatgagaaagagaacaaaagaaaaaaaaataaaaataaaaataaaatttggtcctcttatgtggtgacacgtggtttgaaacccaccaaataatcgatcacaaaaaacctaagttaaggatcggtaataacctttctaattaattttgatttatattaaatcactctttttatttataaaccccactaaattatgcgatattgattgtctaagtacaaaaattctctcgaattcaatacacatgtttcatatatttagccctgttcatttaatattactagcgcatttttaatttaaaattttgtaaacttttttggtcaaagaacatttttttaattagagacagaaatctagactctttatttggaataatagtaataaagatatattaggcaatgagtttatgatgttatgtttatatagtttatttcattttaaattgaaaagcattatttttatcgaaatgaatctagtatacaatcaatatttatgttttttcatcagatactttcctattttttggcacctttcatcggactactgatttatttcaatgtgtatgcatgcatgagcatgagtatacacatgtcttttaaaatgcatgtaaagcgtaacggaccacaaaagaggatccatacaaatacatctcatcgcttcctctactattctccgacacacacactgagcatggtgcttaaacactctggtgagttctagtacttctgctatgatcgatctcattaccatttcttaaatttctctccctaaatattccgagttcttgatttttgataacttcaggttttctctttttgataaatctggtctttccatttttttttttttgtggttaatttagtttcctatgttcttcgattgtattatgcatgatctgtgtttggattctgttagattatgtattggtgaatatgtatgtgtttttgcatgtctggttttggtcttaaaaatgttcaaatctgatgatttgattgaagcttttttagtgttggtttgattcttctcaaaactactgttaatttactatcatgttttccaactttgattcatgatgacacttttgttctgctttgttataaaattttggttggtttgattttgtaattatagtgtaattttgttaggaatgaacatgttttaatactctgttttcgatttgtcacacattcgaattattaatcgataatttaactgaaaattcatggttctagatcttgttgtcatcagattatttgtttcgataattcatcaaatatgtagtccttttgctgatttgcgactgtttcattttttctcaaaattgttttttgttaagtttatctaacagttatcgttgtcaaaagtctctttcattttgcaaaatcttctttttttttttgtttgtaactttgttttttaagctacacatttagtctgtaaaatagcatcgaggaacagttgtcttagtagacttgcatgttcttgtaacttctatttgtttcagtttgttgatgactgctttgattttgtaggtcaaaccgcgccatgtctgctagcggagctttgttgcctgctatagctttcgctgcttacgcttacgctacctacgcttatgctttcgagtggagccacgctaacggaatcgataacgtggatgctagagagtggattggagctttgtctttgagactccctgcaattgcaaccacaatgtacctcttgttctgccttgtgggacctagattgatggctaagagggaggcttttgatcctaagggatttatgctcgcttacaacgcttaccaaaccgctttcaacgttgtggtgctcggaatgttcgctagagagatctctggattgggacaacctgtttggggatctactatgccttggagcgataggaagtccttcaagattttgttgggagtgtggctccactacaacaataagtacctcgagttgttggatactgtgttcatggtggctaggaaaaagaccaagcagctctctttcttgcacgtgtaccaccacgctttgttgatttgggcttggtggcttgtttgtcacctcatggctaccaacgattgcatcgatgcttatttcggagctgcttgcaactctttcatccacatcgtgatgtactcctactacctcatgtctgctttgggaattaggtgcccttggaagagatatatcacccaggctcagatgttgcaattcgtgatcgtgttcgctcacgctgttttcgtgctcagacaaaagcactgccctgttactttgccttgggcacaaatgttcgtgatgacaaatatgttggtgctcttcggaaacttctacctcaaggcttactctaacaagtctaggggagatggagcttcttctgttaagcctgctgagactactagagcaccttctgtgagaagaaccaggtcaaggaagatcgattgatagttaattaactaagtttgatgtatctgagtgccaacgtttactttgtctttcctttcttttattggttatgattagatgtttactatgttctctctttttcgttataaataaagaagttcaattcttctatagtttcaaacgcgattttaagcgtttctatttaggtttacatgatttcttttacaaaatcatctttaaaatacagtatatttttagttttcataaaatatttaaagaaatgaaagtttataaacattcactcctattctctaattaaggatttgtaaaacaaaaattttgtaagcatatcgatttatgcgttttgtcttaattagctcactaaataataaataatagcttatgttgtgggactgtttaattacctaacttagaactaaaatcaactctttgtgggcgcctactaccggtaattcccgggatacctgcaggttaggccggcctgctcggcccggactgtatccaacttgagatctttgaatctctctgttccttgatgttctgaaggagttctaagtgtaatcagaaagcttgtaacatgctttgtagactttctttgatatactcttgcaatgactgattgaacctacgtgaaaactgctggtcaagttctaaccaaattccgtctacggaaggcccaaaatttattgacatcttcagtttcatggacgtgtcttcaaagttttataacttcttatcccatcatttttaagtctagttctgttccgcatagtcttagatctcaaacaaatctacaactcttgtgtcagttcttcttccagaatcaacttgctacatggtgaaaatctggcgtcaagttctgaacttgtcaattttcttaacagttagaaaataatctaagtgtttagaatattgacttttccaaagcaaagaagacttttgactttcttaataaaacaaacttctaattctaacatgtcttgatgaaatgtctttcttgaaatttgatcaagatgcaaaagtcaaagtttgacttttcagactgcaattgaccattttgcagaagtgccaattccaaaccaaaattgatgatacagtgctgcaaacttgatgtcatggaagatcttaacagaaaattcttgaagactgagagcaaaaattttcatgtacaacacaaactttcctgtttttcatagtcgctgtagacacattaacataaaacacctgatcattcgaagagtgattcttgaaggaaatgtgcagttacctttgtgcagaacttaagagcaacttacagactcatttactaaaatactacaatcaggaagattttaacaacttacagaagtattcggagttaaagagcaacacattaagggcgacagttaaaattaatgtgttgtaaccaccactacgaatagtaagtattataagttaaatgtaatcatcacattataattattgtccttataattaattatgataaacatgtatcattaagattgtcataaccaaatagtcctcgacttgatttttgaattattgtattctatgttacttttcttgtagcctatataaaaactttgtaaagcataattgtatgctggaaaaaatactgtaatgaattgaatagaaattatggtatttcattctccaaaatccatcaatagaaatttagtacaaatcgaaagacaaaaatattgacttattttaaattttacaacaatataaaaatattgacttattttaaattttacaataatataaattttcacctgtcacctttagaaatccaccaacaatattaattcttagataaattattcttaataattttgagatctctgtaattatctgatatttattttatatttgtcagttattttcttatgttttactgttaacccttatatcttggtcaaactagaataagtaaatatgagtttgtgaaggacacattgacaagatgaaacattggttttttccttcttcgaatgttaaaggtaataaaacattcagaatattgacctactattaatatagatcctttgtcttttaaaaaagtgtgcatgaaaatgctcttaggtaagctagtgtctcttgcagggctgtgtatatcaattccatttccagatggttgtaactgccactacctataattagtcataagacacgtatgttaacacacgtccccatgcatgttttttgccatatattcccacactttctttttcttcacgtataaaacattgaactaattaatagtccgatcaagctgaacaccatggcttctacatctgctgctcaagacgctgctccttacgagttcccttctctcactgagatcaagagggctcttccttctgagtgtttcgaggcttctgttcctctttctctctactacaccgctagatctcttgctcttgctggatctctcgctgttgctctctcttacgctagagctttgcctcttgttcaggctaacgctcttcttgatgctactctctgcactggatacgttcttctccagggaatcgttttctggggattcttcaccgttggtcacgattgtggacacggagctttctctagatctcacgtgctcaacttctctgttggaaccctcatgcactctatcatccttacccctttcgagtcttggaagctctctcacagacaccaccacaagaacaccggaaacatcgataaggacgagatcttctaccctcaaagagaggctgattctcaccctgtttctagacaccttgtgatgtctcttggatctgcttggttcgcttaccttttcgctggattccctcctagaaccatgaaccacttcaacccttgggaggctatgtatgttagaagagtggctgctgtgatcatctctctcggagttcttttcgctttcgctggactctactcttacctcaccttcgttcttggattcaccactatggctatctactacttcggacctctcttcatcttcgctaccatgcttgttgttaccactttcctccaccacaacgatgaggagacaccttggtacgctgattctgagtggacttacgtgaagggaaacctctcttctgtggacagatcttacggtgctctcatcgacaaccttagccacaacatcggaactcaccagatccaccacctcttccctatcatccctcactacaagctcaacgatgctactgctgctttcgctaaggctttccctgagcttgttaggaaaaacgctgctcctatcatcccaactttcttcaggatggctgctatgtacgctaagtacggagttgttgacactgatgctaagaccttcactctcaaggaggctaaggctgctgctaagactaagtcatcttgatgattaattaaggccgcctcgaccgtaccccctgcagatagactatactatgttttagcctgcctgctggctagctactatgttatgttatgttgtaaaataaacacctgctaaggtatatctatctatattttagcatggctttctcaataaattgtctttccttatcgtttactatcttatacctaataatgaaataataatatcacatatgaggaacggggcaggtttaggcatatatatacgagtgtagggcggagtggggggcgcctaccggtatcggtccgattgcggccgctagtctgtgcgcacttgtatcctgcaggttaggccggccactgcagcaaatttacacattgccactaaacgtctaaacccttgtaatttgtttttgttttactatgtgtgttatgtatttgatttgcgataaatttttatatttggtactaaatttataacaccttttatgctaacgtttgccaacacttagcaatttgcaagttgattaattgattctaaattatttttgtcttctaaatacatatactaatcaactggaaatgtaaatatttgctaatatttctactataggagaattaaagtgagtgaatatggtaccacaaggtttggagatttaattgttgcaatgctgcatggatggcatatacaccaaacattcaataattcttgaggataataatggtaccacacaagatttgaggtgcatgaacgtcacgtggacaaaaggtttagtaatttttcaagacaacaatgttaccacacacaagttttgaggtgcatgcatggatgccctgtggaaagtttaaaaatattttggaaatgatttgcatggaagccatgtgtaaaaccatgacatccacttggaggatgcaataatgaagaaaactacaaatttacatgcaactagttatgcatgtagtctatataatgaggattttgcaatactttcattcatacacactcactaagttttacacgattataatttcttcatagccagtagggtttcgtttttgtttcatcgataaactcaaaggtgatgattttagggtcttgtgagtgtgcttttttgtttgattctactgtagggtttatgttctttagctcataggttttgtgtatttcttagaaatgtggcttctttaatctctgggtttgtgactttttgtgtggtttctgtgtttttcatatcaaaaacctattttttccgagtttttttttacaaattcttactctcaagcttgaatacttcacatgcagtgttcttttgtagattttagagttaatgtgttaaaaagtttggatttttcttgcttatagagcttcttcactttgattttgtgggtttttttgttttaaaggtgagatttttgatgaggtttttgcttcaaagatgtcacctttctgggtttgtcttttgaataaagctatgaactgtcacatggctgacgcaattttgttactatgtcatgaaagctgacgtttttccgtgttatacatgtttgcttacacttgcatgcgtcaaaaaaattggggctttttagttttagtcaaagattttacttctcttttgggatttatgaaggaaagttgcaaactttctcaaattttaccatttttgctttgatgtttgtttagattgcgacagaacaaactcatatatgttgaaatttttgcttggttttgtataggattgtgtcttttgcttataaatgttgaaatctgaactttttttttgtttggtttctttgagcaggagataaggcgcgccttccatggctacaaaggaggcttacgttttcccaactctcaccgagatcaagagatctctcccaaaggattgcttcgaggcttctgtgcctttgtctctctactacactgtgagatgcttggttattgctgtggctttgaccttcggattgaactacgctagagctttgccagaggttgagtctttctgggctttggatgctgctttgtgcactggatatatcctcctccagggaattgtgttctggggattcttcactgttggacacgatgctggacacggagctttctctagataccacctcttgaacttcgttgtgggaaccttcatgcactctctcatcttgaccccattcgagtcttggaagttgacccacagacaccaccacaagaacaccggaaacatcgatagagatgaggtgttctacccacagagaaaggctgatgatcacccattgtccaggaacttgatcttggctttgggagctgcttggcttgcttatttggtggagggattcccaccaagaaaggtgaaccacttcaacccattcgagccactttttgtgagacaagtgtccgctgtggttatctctttgctcgctcacttcttcgttgctggactctctatctacttgtctctccagttgggacttaagaccatggctatctactactacggaccagttttcgtgttcggatctatgttggtgattaccaccttcttgcaccacaacgatgaggagactccatggtatgctgattctgagtggacttacgtgaagggaaacttgtcctctgtggatagatcttacggtgctctcatcgataacctctcccacaacatcggaactcaccagatccaccacctcttcccaattatcccacactacaagctcaagaaggctactgctgctttccaccaagctttcccagagcttgtgagaaagtccgatgagccaatcatcaaggctttcttcagagtgggaaggttgtatgctaactacggagtggttgatcaagaggctaagctcttcactttgaaggaggctaaggctgctactgaagctgctgctaagaccaagtctacctgattaattaaggccgcagatctccaccgcggtggcgctctagcccgatatctcgacaagctcgagtttctccataataatgtgtgagtagttcccagataagggaattagggttcctatagggtttcgctcatgtgttgagcatataagaaacccttagtatgtatttgtatttgtaaaatacttctatcaataaaatttctaattcctaaaaccaaaatccagtactaaaatccagatcccccgaattaattcggcgttaattcagggcaaacactgtacggaccgtggcctaataggccggtaccacccagctttcttgtacaaagtggccatgattacgccaagcttggccactaaggccaatttaaatctactaggccggcctactatagaaaatgtgttatatcgacatgaccagacaaaggggcaacagttaacaaaacaattaattctttcatttgagattaaggaaggtaaggtactaaaaagattaaaaaaaatgagcttatctctttgtttctgtaataataatataagtgtgataaacttttaatataataattgtaattaggttttctacagatgagcaccactcagagacaagataagaagaaaacaattttgttaaacatgattatagaaacttttagttaagtcttgaagtatcaatataacaaaaaaaagtacacacgactatgacaataaacccactaccgtcaggttatcatttcgatgaaatgttttgatatcattaaatataacagtcacaaaaaatcatctaattataacaatataacttatacatatatttaactaaaaacttagagtttttgtaatgattctaattgatgattagagtttatagaaatacaattaaataaaaaatataattttaaaaaaacatagtaaagtcaatgagatcctctctgacctcagtgatcatttagtcatgtatgtacaacaatcattgttcatcacatgactgtaaaataaataaggataaacttgggaatatatataatatattgtattaaataaaaaagggaaatacaaatatcaattttagattcccgagttgacacaactcaccatgcacgctgccacctcagctcccagctctcgtcacatgtctcatgtcagttaggtctttggtttttagtctttgacacaactcgccatgcatgttgccacgtgagctcgttcctcttcccatgatctcaccactgggcatgcatgctgccacctcagctggcacctcttctctatatgtccctagaggccatgcacagtgccacctcagcactcctctcagaacccatacgtacctgccaatcggcttctctccataaatatctatttaaattataactaattatttcatatacttaattgatgacgtggatgcattgccatcgttgtttaataattgttaattacgacatgataaataaaatgaaagtaaaaagtacgaaagattttccatttgttgttgtataaatagagaagtgagtgatgcataatgcatgaatgcatgaccgcgccaccatgactgttggatacgatgaggagatcccattcgagcaagttagggctcataacaagccagatgatgcttggtgtgctattcatggacacgtgtacgatgttaccaagttcgcttctgttcatccaggaggagatattatcttgctcgctgctggaaaggaagctactgtgctctacgagacctaccatgttagaggagtgtctgatgctgtgctcagaaagtacagaatcggaaagttgccagatggacaaggaggagctaacgagaaggagaagagaaccttgtctggattgtcctctgcttcttactacacctggaactccgatttctacagagtgatgagggagagagttgtggctagattgaaggagagaggaaaggctagaagaggaggatacgagttgtggatcaaggctttcttgctccttgttggattctggtcctctctttactggatgtgcaccctcgatccatctttcggagctatcttggctgctatgtctttgggagtgttcgctgcttttgttggaacctgcatccaacatgatggaaaccatggagctttcgctcaatctagatgggttaacaaggtggcaggatggactttggatatgatcggagcttctggaatgacttgggagttccaacatgtgttgggacatcacccatacactaacttgatcgaggaggagaacggattgcaaaaggtgtccggaaagaagatggataccaagttggctgatcaagagtctgatccagatgtgttctccacctacccaatgatgagattgcatccatggcatcagaagagatggtatcacaggttccagcatatctacggaccattcatcttcggattcatgaccatcaacaaggtggtgactcaagatgttggagtggtgttgagaaagaggctcttccaaatcgatgctgagtgcagatatgcttccccaatgtacgttgctaggttctggatcatgaaggctttgaccgtgttgtacatggttgctctcccatgttatatgcaaggaccatggcatggattgaagctcttcgctatcgctcatttcacttgcggagaggttttggctaccatgttcatcgtgaaccacattatcgagggagtgtcttacgcttctaaggatgctgttaagggaactatggctccaccaaagactatgcatggagtgaccccaatgaacaacactagaaaggaggttgaggctgaggcttctaagtctggagctgtggttaagtctgtgccattggatgattgggctgctgttcaatgccaaacctctgtgaactggtctgttggatcttggttctggaaccatttctctggaggactcaaccatcaaatcgagcatcatctcttcccaggattgtctcacgagacctactaccacatccaagatgtggttcaatctacctgtgctgagtacggagttccataccaacatgagccatctttgtggactgcttactggaagatgctcgaacatttgagacaattgggaaacgaggagactcacgagtcttggcaaagagctgcttgattaattaactaagactcccaaaaccaccttccctgtgacagttaaaccctgcttatacctttcctcctaataatgttcatctgtcacacaaactaaaataaataaaatgggagcaataaataaaatgggagctcatatatttacaccatttacactgtctattattcaccatgccaattattacttcataattttaaaattatgtcatttttaaaaattgcttaatgatggaaaggattattataagttaaaagtataacatagataaactaaccacaaaacaaatcaatataaactaacttactctcccatctaatttttatttaaatttctttacacttctcttccatttctatttctacaacattatttaacatttttattgtatttttcttactttctaactctattcatttcaaaaatcaatatatgtttatcaccacctctctaaaaaaaactttacaatcattggtccagaaaagttaaatcacgagatggtcattttagcattaaaacaacgattcttgtatcactatttttcagcatgtagtccattctcttcaaacaaagacagcggctatataatcgttgtgttatattcagtctaaaacaaggcgcctactaccggtaattcccgggattagcggccgctagtctgtgcgcacttgtatcctgcaggttaggccggccaaagctttacaacgctacacaaaacttataaccgtaatcaccattcattaacttaactactatcacatgcattcatgaattgaaacgagaaggatgtaaatagttgggaagttatctccacgttgaagagatcgttagcgagagctgaaagaccgagggaggagacgccgtcaacacggacagagtcgtcgaccctcacatgaagtaggaggaatctccgtgaggagccagagagacgtctttggtcttcggtttcgatccttgatctgacggagaagacgagagaagtgcgactggactccgtgaggaccaacagagtcgtcctcggtttcgatcgtcggtattggtggagaaggcggaggaatctccgtgacgagccagagagatgtcgtcggtcttcggtttcgatccttgatctgacggagaagacgagagaagtgcgacgagactccgtgaggaccaacagagttgtcctcggtttcgatcgtcggtttcggcggagaaggcggaggaatctccgtgaggagccagagagacgtcgttggtcttcggtttcgatccttgatctgttggagaagacgagacaagtgggacgagactcaacgacggagtcagagacgtcgtcggtcttcggtttcggccgagaaggcggagtcggtcttcggtttcggccgagaaggcggaggagacgtcttcgatttgggtctctcctcttgacgaagaaaacaaagaacacgagaaataatgagaaagagaacaaaagaaaaaaaaataaaaataaaaataaaatttggtcctcttatgtggtgacacgtggtttgaaacccaccaaataatcgatcacaaaaaacctaagttaaggatcggtaataacctttctaattaattttgatttatattaaatcactctttttatttataaaccccactaaattatgcgatattgattgtctaagtacaaaaattctctcgaattcaatacacatgtttcatatatttagccctgttcatttaatattactagcgcatttttaatttaaaattttgtaaacttttttggtcaaagaacatttttttaattagagacagaaatctagactctttatttggaataatagtaataaagatatattaggcaatgagtttatgatgttatgtttatatagtttatttcattttaaattgaaaagcattatttttatcgaaatgaatctagtatacaatcaatatttatgttttttcatcagatactttcctattttttggcacctttcatcggactactgatttatttcaatgtgtatgcatgcatgagcatgagtatacacatgtcttttaaaatgcatgtaaagcgtaacggaccacaaaagaggatccatacaaatacatctcatcgcttcctctactattctccgacacacacactgagcaaccctaccatgtgtgttgagaccgagaacaacgatggaatccctactgtggagatcgctttcgatggagagagagaaagagctgaggctaacgtgaagttgtctgctgagaagatggaacctgctgctttggctaagaccttcgctagaagatacgtggttatcgagggagttgagtacgatgtgaccgatttcaaacatcctggaggaaccgtgattttctacgctctctctaacactggagctgatgctactgaggctttcaaggagttccaccacagatctagaaaggctaggaaggctttggctgctttgccttctagacctgctaagaccgctaaagtggatgatgctgagatgctccaggatttcgctaagtggagaaaggagttggagagggacggattcttcaagccttctcctgctcatgttgcttacagattcgctgagttggctgctatgtacgctttgggaacctacttgatgtacgctagatacgttgtgtcctctgtgttggtttacgcttgcttcttcggagctagatgtggatgggttcaacacgagggaggacactcttctttgaccggaaacatctggtgggataagagaatccaagctttcactgctggattcggattggctggatctggagatatgtggaactccatgcacaacaagcaccacgctactcctcaaaaagtgaggcacgatatggatttggataccactcctgctgttgctttcttcaacaccgctgtggaggataatagacctaggggattctctaagtactggctcagattgcaagcttggaccttcattcctgtgacttctggattggtgttgctcttctggatgttcttcctccacccttctaaggctttgaagggaggaaagtacgaggagcttgtgtggatgttggctgctcacgtgattagaacctggaccattaaggctgttactggattcaccgctatgcaatcctacggactcttcttggctacttcttgggtttccggatgctacttgttcgctcacttctctacttctcacacccacttggatgttgttcctgctgatgagcacttgtcttgggttaggtacgctgtggatcacaccattgatatcgatccttctcagggatgggttaactggttgatgggatacttgaactgccaagtgattcaccacctcttcccttctatgcctcaattcagacaacctgaggtgtccagaagattcgttgctttcgctaagaagtggaacctcaactacaaggtgatgacttatgctggagcttggaaggctactttgggaaacctcgataatgtgggaaagcactactacgtgcacggacaacactctggaaagaccgcttgattaattaactaagtttgatgtatctgagtgccaacgtttactttgtctttcctttcttttattggttatgattagatgtttactatgttctctctttttcgttataaataaagaagttcaattcttctatagtttcaaacgcgattttaagcgtttctatttaggtttacatgatttcttttacaaaatcatctttaaaatacagtatatttttagttttcataaaatatttaaagaaatgaaagtttataaacattcactcctattctctaattaaggatttgtaaaacaaaaattttgtaagcatatcgatttatgcgttttgtcttaattagctcactaaataataaataatagcttatgttgtgggactgtttaattacctaacttagaactaaaatcaactctttgtgggcaaacactgtacggaccgtggcctaataggccggtacccaactttattatacatagttgataattcactggccggatgtaccgaattcgcggccgcaagcttgtacactagtacgcgtcaattggcgatcgcagtacttaatcagtgatcagtaactaaattcagtacattaaagacgtccgcaatgtgttattaagttgtctaagcgtcaatttgtttacaccacaatatatcctgccaccagccagccaacagctccccgaccggcagctcggcacaaaatcactgatcatctaaaaaggtgatgtgtatttgagtaaaacagcttgcgtcatgcggtcgctgcgtatatgatgcgatgagtaaataaacaaatacgcaaggggaacgcatgaaggttatcgctgtacttaaccagaaaggcgggtcaggcaagacgaccatcgcaacccatctagcccgcgccctgcaactcgccggggccgatgttctgttagtcgattccgatccccagggcagtgcccgcgattgggcggccgtgcgggaagatcaaccgctaaccgttgtcggcatcgaccgcccgacgattgaccgcgacgtgaaggccatcggccggcgcgacttcgtagtgatcgacggagcgccccaggcggcggacttggctgtgtccgcgatcaaggcagccgacttcgtgctgattccggtgcagccaagcccttacgacatttgggccaccgccgacctggtggagctggttaagcagcgcattgaggtcacggatggaaggctacaagcggcctttgtcgtgtcgcgggcgatcaaaggcacgcgcatcggcggtgaggttgccgaggcgctggccgggtacgagctgcccattcttgagtcccgtatcacgcagcgcgtgagctacccaggcactgccgccgccggcacaaccgttcttgaatcagaacccgagggcgacgctgcccgcgaggtccaggcgctggccgctgaaattaaatcaaaactcatttgagttaatgaggtaaagagaaaatgagcaaaagcacaaacacgctaagtgccggccgtccgagcgcacgcagcagcaaggctgcaacgttggccagcctggcagacacgccagccatgaagcgggtcaactttcagttgccggcggaggatcacaccaagctgaagatgtacgcggtacgccaaggcaagaccattaccgagctgctatctgaatacatcgcgcagctaccagagtaaatgagcaaatgaataaatgagtagatgaattttagcggctaaaggaggcggcatggaaaatcaagaacaaccaggcaccgacgccgtggaatgccccatgtgtggaggaacgggcggttggccaggcgtaagcggctgggttgtctgccggccctgcaatggcactggaacccccaagcccgaggaatcggcgtgagcggtcgcaaaccatccggcccggtacaaatcggcgcggcgctgggtgatgacctggtggagaagttgaaggccgcgcaggccgcccagcggcaacgcatcgaggcagaagcacgccccggtgaatcgtggcaaggggccgctgatcgaatccgcaaagaatcccggcaaccgccggcagccggtgcgccgtcgattaggaagccgcccaagggcgacgagcaaccagattttttcgttccgatgctctatgacgtgggcacccgcgatagtcgcagcatcatggacgtggccgttttccgtctgtcgaagcgtgaccgacgagctggcgaggtgatccgctacgagcttccagacgggcacgtagaggtttccgcaggccccgccggcatggccagtgtgtgggattacgacctggtactgatggcggtttcccatctaaccgaatccatgaaccgataccgggaagggaagggagacaagcccggccgcgtgttccgtccacacgttgcggacgtactcaagttctgccggcgagccgatggcggaaagcagaaagacgacctggtagaaacctgcattcggttaaacaccacgcacgttgccatgcagcgtaccaagaaggccaagaacggccgcctggtgacggtatccgagggtgaagccttgattagccgctacaagatcgtaaagagcgaaaccgggcggccggagtacatcgagatcgagcttgctgattggatgtaccgcgagatcacagaaggcaagaacccggacgtgctgacggttcaccccgattactttttgatcgaccccggcatcggccgttttctctaccgcctggcacgccgcgccgcaggcaaggcagaagccagatggttgttcaagacgatctacgaacgcagtggcagcgccggagagttcaagaagttctgtttcaccgtgcgcaagctgatcgggtcaaatgacctgccggagtacgatttgaaggaggaggcggggcaggctggcccgatcctagtcatgcgctaccgcaacctgatcgagggcgaagcatccgccggttcctaatgtacggagcagatgctagggcaaattgccctagcaggggaaaaaggtcgaaaaggtctctttcctgtggatagcacgtacattgggaacccaaagccgtacattgggaaccggaacccgtacattgggaacccaaagccgtacattgggaaccggtcacacatgtaagtgactgatataaaagagaaaaaaggcgatttttccgcctaaaactctttaaaacttattaaaactcttaaaacccgcctggcctgtgcataactgtctggccagcgcacagccgaagagctgcaaaaagcgcctacccttcggtcgctgcgctccctacgccccgccgcttcgcgtcggcctatcgcggcctatgcggtgtgaaataccgcacagatgcgtaaggagaaaataccgcatcaggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtccttcaactcatcgatagtttggctgtgagcaattatgtgcttagtgcatctaacgcttgagttaagccgcgccgcgaagcggcgtcggcttgaacgaatttctagctagacattatttgccaacgaccttcgtgatctcgcccttgacatagtggacaaattcttcgagctggtcggcccgggacgcgagacggtcttcttcttggcccagataggcttggcgcgcttcgaggatcacgggctggtattgcgccggaaggcgctccatcgcccagtcggcggcgacatccttcggcgcgatcttgccggtaaccgccgagtaccaaatccggctcagcgtaaggaccacattgcgctcatcgcccgcccaatccggcggggagttccacagggtcagcgtctcgttcagtgcttcgaacagatcctgttccggcaccgggtcgaaaagttcctcggccgcggggccgacgagggccacgctatgctcccgggccttggtgagcaggatcgccagatcaatgtcgatggtggccggttcaaagatacccgccagaatatcattacgctgccattcgccgaactggagttcgcgtttggccggatagcgccaggggatgatgtcatcgtgcaccacaatcgtcacctcaaccgcgcgcaggatttcgctctcgccgggggaggcggacgtttccagaaggtcgttgataagcgcgcggcgcgtggtctcgtcgagacggacggtaacggtgacaagcaggtcgatgtccgaatggggcttaaggccgccgtcaacggcgctaccatacagatgcacggcgaggagggtcggttcgaggtggcgctcgatgacacccacgacttccgacagctgggtggacacctcggcgatgaccgcttcacccatgatgtttaactttgttttagggcgactgccctgctgcgtaacatcgttgctgctccataacatcaaacatcgacccacggcgtaacgcgcttgctgcttggatgcccgaggcatagactgtaccccaaaaaaacagtcataacaagccatgaaaaccgccactgcgttccatgaatattcaaacaaacacatacagcgcgacttatcatggata

SEQ ID NO: 8 - DNA, 21523 bp, Artificial Sequence
  plasmid
ttgacatacaaatggacgaacggataaaccttttcacgcccttttaaatatccgattattctaataaacgctcttttctcttaggtttacccgccaatatatcctgtcaaacactgatagtttaaactgaaggcgggaaacgacaatctgatcactgattagtaactaaggcctttaattaatctagaggcgcgccgggccccctgcagggagctcggccggccaatttaaattgatatcggtacatcgattacgccaagctatcaactttgtatagaaaagttgccatgattacgccaagcttggccactaaggccaatttaaatctactaggccggccattagcagatatttggtgtctaaatgtttattttgtgatatgttcatgtttgaaatggtggtttcgaaaccagggacaacgttgggatctgatagggtgtcaaagagtattatggattgggacaatttcggtcatgagttgcaaattcaagtatatcgttcgattatgaaaattttcgaagaatatcccatttgagagagtctttacctcattaatgtttttagattatgaaattttatcatagttcatcgtagtctttttggtgtaaaggctgtaaaaagaaattgttcacttttgttttcgtttatgtgaaggctgtaaaagattgtaaaagactattttggtgttttggataaaatgatagtttttatagattcttttgcttttagaagaaatacatttgaaattttttccatgttgagtataaaataccgaaatcgattgaagatcatagaaatattttaactgaaaacaaatttataactgattcaattctctccatttttatacctatttaaccgtaatcgattctaatagatgatcgattttttatataatcctaattaaccaacggcatgtattggataattaaccgatcaactctcacccctaatagaatcagtattttccttcgacgttaattgatcctacactatgtaggtcatatccatcgttttaatttttggccaccattcaattctgtcttgcctttagggatgtgaatatgaacggccaaggtaagagaataaaaataatccaaattaaagcaagagaggccaagtaagataatccaaatgtacacttgtcattgccaaaattagtaaaatactcggcatattgtattcccacacattattaaaataccgtatatgtattggctgcatttgcatgaataatactacgtgtaagcccaaaagaacccacgtgtagcccatgcaaagttaacactcacgaccccattcctcagtctccactatataaacccaccatccccaatctcaccaaacccaccacacaactcacaactcactctcacaccttaaagaaccaatcaccaccaaaaaaccgcgccaccatgcttgttcttttcggaaacttctacgtgaagcagtactctcaaaagaacggaaagcctgagaacggtgctactcctgaaaacggtgcaaagcctcaaccttgtgagaacggaactgttgagaagagggagaacgataccgctaatgttagacctactagaccagctggacctcctcctgctacttactacgattctctcgctgtttctggacagggaaaagagagacttttcaccaccgacgaagttagaaggcacatcctccctactgacggatggcttacttgtcacgagggagtttacgacgttactgacttccttgcaaaacaccctggtggaggtgttatcactcttggactcggaagagattgcactatcctcatcgagtcttaccaccctgctggtagacctgataaggtgatggaaaagtaccgtatcggaactcttcaagaccctaagactttctacgcttggggagagtctgatttctaccctgagcttaagagaagggctcttgctagacttaaagaggctggacaagctagaagaggtggacttggagttaaggctctccttgttcttactctcttcttcgtgtcttggtatatgtgggttgcacacaagtctttcttgtgggctgctgtttggggattcgctggatcacatgtgggactttctatccagcacgacggaaaccacggtgctttctctagaaacaccctcgttaacagacttgctggatggggaatggatcttatcggagcttcttctactgtttgggagtaccagcacgttatcggacaccaccagtacactaacctcgtttctgatacccttttcagccttcctgagaacgatcctgatgtgttctcttcttaccctctcatgagaatgcaccctgatactgcttggcaacctcaccacagattccagcaccttttcgctttccctttgttcgctctcatgaccatctctaaggttctcacctctgatttcgctgtttgcctctctatgaagaagggatctatcgattgctctagcagacttgttcctcttgagggacaacttcttttctggggtgctaaacttgctaacttcctcctccaaatcgttcttccttgttaccttcacggaactgctatgggacttgctcttttctctgttgctcaccttgtttctggtgagtaccttgctatctgcttcatcatcaaccacatctctgagtcttgtgagttcatgaacacctcattccaaactgctgctagaagaactgagatgcttcaagctgctcatcaagctgctgaggctaagaaggttaagcctactcctcctcctaacgattgggctgttactcaagttcagtgctgtgttaactggcgttctggtggagttcttgctaaccacctttctggtggacttaaccaccagatcgagcaccacctcttcccttctatctctcacgctaactaccctactatcgctcctgttgtgaaagaagtgtgcgaggaatacggacttccttacaagaactacgtgaccttctgggatgctgtttgtggaatggttcagcaccttagacttatgggtgctcctcctgttcctactaacggtgacaaaaaaagttgatgattaattaataattgattgctgctttaatgagatatgcgagacgcctatgatcgcatgatatttgctttcaattctgttgtgcacgttgtaaaaaacctgagcatgtgtagctcagatccttaccgccggtttcggttcattctaatgaatatatcacccgttactatcgtatttttatgaataatattctccgttcaatttactgattgtggcgcctactaccggtaattcccgggattagcggccgctagtctgtgcgcacttgtatcctgcaggtcaatcgtttaaacactgtacggaccgtggcctaataggccggtacccaagtttgtacaaaaaagcaggctccatgattacgccaagcttggccactaaggccaatttaaatctactaggccggccaaagctttacaacgctacacaaaacttataaccgtaatcaccattcattaacttaactactatcacatgcattcatgaattgaaacgagaaggatgtaaatagttgggaagttatctccacgttgaagagatcgttagcgagagctgaaagaccgagggaggagacgccgtcaacacggacagagtcgtcgaccctcacatgaagtaggaggaatctccgtgaggagccagagagacgtctttggtcttcggtttcgatccttgatctgacggagaagacgagagaagtgcgactggactccgtgaggaccaacagagtcgtcctcggtttcgatcgtcggtattggtggagaaggcggaggaatctccgtgacgagccagagagatgtcgtcggtcttcggtttcgatccttgatctgacggagaagacgagagaagtgcgacgagactccgtgaggaccaacagagttgtcctcggtttcgatcgtcggtttcggcggagaaggcggaggaatctccgtgaggagccagagagacgtcgttggtcttcggtttcgatccttgatctgttggagaagacgagacaagtgggacgagactcaacgacggagtcagagacgtcgtcggtcttcggtttcggccgagaaggcggagtcggtcttcggtttcggccgagaaggcggaggagacgtcttcgatttgggtctctcctcttgacgaagaaaacaaagaacacgagaaataatgagaaagagaacaaaagaaaaaaaaataaaaataaaaataaaatttggtcctcttatgtggtgacacgtggtttgaaacccaccaaataatcgatcacaaaaaacctaagttaaggatcggtaataacctttctaattaattttgatttatattaaatcactctttttatttataaaccccactaaattatgcgatattgattgtctaagtacaaaaattctctcgaattcaatacacatgtttcatatatttagccctgttcatttaatattactagcgcatttttaatttaaaattttgtaaacttttttggtcaaagaacatttttttaattagagacagaaatctagactctttatttggaataatagtaataaagatatattaggcaatgagtttatgatgttatgtttatatagtttatttcattttaaattgaaaagcattatttttatcgaaatgaatctagtatacaatcaatatttatgttttttcatcagatactttcctattttttggcacctttcatcggactactgatttatttcaatgtgtatgcatgcatgagcatgagtatacacatgtcttttaaaatgcatgtaaagcgtaacggaccacaaaagaggatccatacaaatacatctcatcgcttcctctactattctccgacacacacactgagcatggtgcttaaacactctggtgagttctagtacttctgctatgatcgatctcattaccatttcttaaatttctctccctaaatattccgagttcttgatttttgataacttcaggttttctctttttgataaatctggtctttccatttttttttttttgtggttaatttagtttcctatgttcttcgattgtattatgcatgatctgtgtttggattctgttagattatgtattggtgaatatgtatgtgtttttgcatgtctggttttggtcttaaaaatgttcaaatctgatgatttgattgaagcttttttagtgttggtttgattcttctcaaaactactgttaatttactatcatgttttccaactttgattcatgatgacacttttgttctgctttgttataaaattttggttggtttgattttgtaattatagtgtaattttgttaggaatgaacatgttttaatactctgttttcgatttgtcacacattcgaattattaatcgataatttaactgaaaattcatggttctagatcttgttgtcatcagattatttgtttcgataattcatcaaatatgtagtccttttgctgatttgcgactgtttcattttttctcaaaattgttttttgttaagtttatctaacagttatcgttgtcaaaagtctctttcattttgcaaaatcttctttttttttttgtttgtaactttgttttttaagctacacatttagtctgtaaaatagcatcgaggaacagttgtcttagtagacttgcatgttcttgtaacttctatttgtttcagtttgttgatgactgctttgattttgtaggtcaaaccgcgccatgtctgctagcggagctttgttgcctgctatagctttcgctgcttacgcttacgctacctacgcttatgctttcgagtggagccacgctaacggaatcgataacgtggatgctagagagtggattggagctttgtctttgagactccctgcaattgcaaccacaatgtacctcttgttctgccttgtgggacctagattgatggctaagagggaggcttttgatcctaagggatttatgctcgcttacaacgcttaccaaaccgctttcaacgttgtggtgctcggaatgttcgctagagagatctctggattgggacaacctgtttggggatctactatgccttggagcgataggaagtccttcaagattttgttgggagtgtggctccactacaacaataagtacctcgagttgttggatactgtgttcatggtggctaggaaaaagaccaagcagctctctttcttgcacgtgtaccaccacgctttgttgatttgggcttggtggcttgtttgtcacctcatggctaccaacgattgcatcgatgcttatttcggagctgcttgcaactctttcatccacatcgtgatgtactcctactacctcatgtctgctttgggaattaggtgcccttggaagagatatatcacccaggctcagatgttgcaattcgtgatcgtgttcgctcacgctgttttcgtgctcagacaaaagcactgccctgttactttgccttgggcacaaatgttcgtgatgacaaatatgttggtgctcttcggaaacttctacctcaaggcttactctaacaagtctaggggagatggagcttcttctgttaagcctgctgagactactagagcaccttctgtgagaagaaccaggtcaaggaagatcgattgatagttaattaactaagtttgatgtatctgagtgccaacgtttactttgtctttcctttcttttattggttatgattagatgtttactatgttctctctttttcgttataaataaagaagttcaattcttctatagtttcaaacgcgattttaagcgtttctatttaggtttacatgatttcttttacaaaatcatctttaaaatacagtatatttttagttttcataaaatatttaaagaaatgaaagtttataaacattcactcctattctctaattaaggatttgtaaaacaaaaattttgtaagcatatcgatttatgcgttttgtcttaattagctcactaaataataaataatagcttatgttgtgggactgtttaattacctaacttagaactaaaatcaactctttgtgggcgcctactaccggtaattcccgggatacctgcaggttaggccggcctgctcggcccggactgtatccaacttgagatctttgaatctctctgttccttgatgttctgaaggagttctaagtgtaatcagaaagcttgtaacatgctttgtagactttctttgatatactcttgcaatgactgattgaacctacgtgaaaactgctggtcaagttctaaccaaattccgtctacggaaggcccaaaatttattgacatcttcagtttcatggacgtgtcttcaaagttttataacttcttatcccatcatttttaagtctagttctgttccgcatagtcttagatctcaaacaaatctacaactcttgtgtcagttcttcttccagaatcaacttgctacatggtgaaaatctggcgtcaagttctgaacttgtcaattttcttaacagttagaaaataatctaagtgtttagaatattgacttttccaaagcaaagaagacttttgactttcttaataaaacaaacttctaattctaacatgtcttgatgaaatgtctttcttgaaatttgatcaagatgcaaaagtcaaagtttgacttttcagactgcaattgaccattttgcagaagtgccaattccaaaccaaaattgatgatacagtgctgcaaacttgatgtcatggaagatcttaacagaaaattcttgaagactgagagcaaaaattttcatgtacaacacaaactttcctgtttttcatagtcgctgtagacacattaacataaaacacctgatcattcgaagagtgattcttgaaggaaatgtgcagttacctttgtgcagaacttaagagcaacttacagactcatttactaaaatactacaatcaggaagattttaacaacttacagaagtattcggagttaaagagcaacacattaagggcgacagttaaaattaatgtgttgtaaccaccactacgaatagtaagtattataagttaaatgtaatcatcacattataattattgtccttataattaattatgataaacatgtatcattaagattgtcataaccaaatagtcctcgacttgatttttgaattattgtattctatgttacttttcttgtagcctatataaaaactttgtaaagcataattgtatgctggaaaaaatactgtaatgaattgaatagaaattatggtatttcattctccaaaatccatcaatagaaatttagtacaaatcgaaagacaaaaatattgacttattttaaattttacaacaatataaaaatattgacttattttaaattttacaataatataaattttcacctgtcacctttagaaatccaccaacaatattaattcttagataaattattcttaataattttgagatctctgtaattatctgatatttattttatatttgtcagttattttcttatgttttactgttaacccttatatcttggtcaaactagaataagtaaatatgagtttgtgaaggacacattgacaagatgaaacattggttttttccttcttcgaatgttaaaggtaataaaacattcagaatattgacctactattaatatagatcctttgtcttttaaaaaagtgtgcatgaaaatgctcttaggtaagctagtgtctcttgcagggctgtgtatatcaattccatttccagatggttgtaactgccactacctataattagtcataagacacgtatgttaacacacgtccccatgcatgttttttgccatatattcccacactttctttttcttcacgtataaaacattgaactaattaatagtccgatcaagctgaacaccatggcttctacatctgctgctcaagacgctgctccttacgagttcccttctctcactgagatcaagagggctcttccttctgagtgtttcgaggcttctgttcctctttctctctactacaccgctagatctcttgctcttgctggatctctcgctgttgctctctcttacgctagagctttgcctcttgttcaggctaacgctcttcttgatgctactctctgcactggatacgttcttctccagggaatcgttttctggggattcttcaccgttggtcacgattgtggacacggagctttctctagatctcacgtgctcaacttctctgttggaaccctcatgcactctatcatccttacccctttcgagtcttggaagctctctcacagacaccaccacaagaacaccggaaacatcgataaggacgagatcttctaccctcaaagagaggctgattctcaccctgtttctagacaccttgtgatgtctcttggatctgcttggttcgcttaccttttcgctggattccctcctagaaccatgaaccacttcaacccttgggaggctatgtatgttagaagagtggctgctgtgatcatctctctcggagttcttttcgctttcgctggactctactcttacctcaccttcgttcttggattcaccactatggctatctactacttcggacctctcttcatcttcgctaccatgcttgttgttaccactttcctccaccacaacgatgaggagacaccttggtacgctgattctgagtggacttacgtgaagggaaacctctcttctgtggacagatcttacggtgctctcatcgacaaccttagccacaacatcggaactcaccagatccaccacctcttccctatcatccctcactacaagctcaacgatgctactgctgctttcgctaaggctttccctgagcttgttaggaaaaacgctgctcctatcatcccaactttcttcaggatggctgctatgtacgctaagtacggagttgttgacactgatgctaagaccttcactctcaaggaggctaaggctgctgctaagactaagtcatcttgatgattaattaaggccgcctcgaccgtaccccctgcagatagactatactatgttttagcctgcctgctggctagctactatgttatgttatgttgtaaaataaacacctgctaaggtatatctatctatattttagcatggctttctcaataaattgtctttccttatcgtttactatcttatacctaataatgaaataataatatcacatatgaggaacggggcaggtttaggcatatatatacgagtgtagggcggagtggggggcgcctaccggtatcggtccgattgcggccgctagtctgtgcgcacttgtatcctgcaggttaggccggccactgcagcaaatttacacattgccactaaacgtctaaacccttgtaatttgtttttgttttactatgtgtgttatgtatttgatttgcgataaatttttatatttggtactaaatttataacaccttttatgctaacgtttgccaacacttagcaatttgcaagttgattaattgattctaaattatttttgtcttctaaatacatatactaatcaactggaaatgtaaatatttgctaatatttctactataggagaattaaagtgagtgaatatggtaccacaaggtttggagatttaattgttgcaatgctgcatggatggcatatacaccaaacattcaataattcttgaggataataatggtaccacacaagatttgaggtgcatgaacgtcacgtggacaaaaggtttagtaatttttcaagacaacaatgttaccacacacaagttttgaggtgcatgcatggatgccctgtggaaagtttaaaaatattttggaaatgatttgcatggaagccatgtgtaaaaccatgacatccacttggaggatgcaataatgaagaaaactacaaatttacatgcaactagttatgcatgtagtctatataatgaggattttgcaatactttcattcatacacactcactaagttttacacgattataatttcttcatagccagtagggtttcgtttttgtttcatcgataaactcaaaggtgatgattttagggtcttgtgagtgtgcttttttgtttgattctactgtagggtttatgttctttagctcataggttttgtgtatttcttagaaatgtggcttctttaatctctgggtttgtgactttttgtgtggtttctgtgtttttcatatcaaaaacctattttttccgagtttttttttacaaattcttactctcaagcttgaatacttcacatgcagtgttcttttgtagattttagagttaatgtgttaaaaagtttggatttttcttgcttatagagcttcttcactttgattttgtgggtttttttgttttaaaggtgagatttttgatgaggtttttgcttcaaagatgtcacctttctgggtttgtcttttgaataaagctatgaactgtcacatggctgacgcaattttgttactatgtcatgaaagctgacgtttttccgtgttatacatgtttgcttacacttgcatgcgtcaaaaaaattggggctttttagttttagtcaaagattttacttctcttttgggatttatgaaggaaagttgcaaactttctcaaattttaccatttttgctttgatgtttgtttagattgcgacagaacaaactcatatatgttgaaatttttgcttggttttgtataggattgtgtcttttgcttataaatgttgaaatctgaactttttttttgtttggtttctttgagcaggagataaggcgcgccttccatggctacaaaggaggcttacgttttcccaactctcaccgagatcaagagatctctcccaaaggattgcttcgaggcttctgtgcctttgtctctctactacactgtgagatgcttggttattgctgtggctttgaccttcggattgaactacgctagagctttgccagaggttgagtctttctgggctttggatgctgctttgtgcactggatatatcctcctccagggaattgtgttctggggattcttcactgttggacacgatgctggacacggagctttctctagataccacctcttgaacttcgttgtgggaaccttcatgcactctctcatcttgaccccattcgagtcttggaagttgacccacagacaccaccacaagaacaccggaaacatcgatagagatgaggtgttctacccacagagaaaggctgatgatcacccattgtccaggaacttgatcttggctttgggagctgcttggcttgcttatttggtggagggattcccaccaagaaaggtgaaccacttcaacccattcgagccactttttgtgagacaagtgtccgctgtggttatctctttgctcgctcacttcttcgttgctggactctctatctacttgtctctccagttgggacttaagaccatggctatctactactacggaccagttttcgtgttcggatctatgttggtgattaccaccttcttgcaccacaacgatgaggagactccatggtatgctgattctgagtggacttacgtgaagggaaacttgtcctctgtggatagatcttacggtgctctcatcgataacctctcccacaacatcggaactcaccagatccaccacctcttcccaattatcccacactacaagctcaagaaggctactgctgctttccaccaagctttcccagagcttgtgagaaagtccgatgagccaatcatcaaggctttcttcagagtgggaaggttgtatgctaactacggagtggttgatcaagaggctaagctcttcactttgaaggaggctaaggctgctactgaagctgctgctaagaccaagtctacctgattaattaaggccgcagatctccaccgcggtggcgctctagcccgatatctcgacaagctcgagtttctccataataatgtgtgagtagttcccagataagggaattagggttcctatagggtttcgctcatgtgttgagcatataagaaacccttagtatgtatttgtatttgtaaaatacttctatcaataaaatttctaattcctaaaaccaaaatccagtactaaaatccagatcccccgaattaattcggcgttaattcagggcaaacactgtacggaccgtggcctaataggccggtaccacccagctttcttgtacaaagtggccatgattacgccaagcttggccactaaggccaatttaaatctactaggccggcctactatagaaaatgtgttatatcgacatgaccagacaaaggggcaacagttaacaaaacaattaattctttcatttgagattaaggaaggtaaggtactaaaaagattaaaaaaaatgagcttatctctttgtttctgtaataataatataagtgtgataaacttttaatataataattgtaattaggttttctacagatgagcaccactcagagacaagataagaagaaaacaattttgttaaacatgattatagaaacttttagttaagtcttgaagtatcaatataacaaaaaaaagtacacacgactatgacaataaacccactaccgtcaggttatcatttcgatgaaatgttttgatatcattaaatataacagtcacaaaaaatcatctaattataacaatataacttatacatatatttaactaaaaacttagagtttttgtaatgattctaattgatgattagagtttatagaaatacaattaaataaaaaatataattttaaaaaaacatagtaaagtcaatgagatcctctctgacctcagtgatcatttagtcatgtatgtacaacaatcattgttcatcacatgactgtaaaataaataaggataaacttgggaatatatataatatattgtattaaataaaaaagggaaatacaaatatcaattttagattcccgagttgacacaactcaccatgcacgctgccacctcagctcccagctctcgtcacatgtctcatgtcagttaggtctttggtttttagtctttgacacaactcgccatgcatgttgccacgtgagctcgttcctcttcccatgatctcaccactgggcatgcatgctgccacctcagctggcacctcttctctatatgtccctagaggccatgcacagtgccacctcagcactcctctcagaacccatacgtacctgccaatcggcttctctccataaatatctatttaaattataactaattatttcatatacttaattgatgacgtggatgcattgccatcgttgtttaataattgttaattacgacatgataaataaaatgaaagtaaaaagtacgaaagattttccatttgttgttgtataaatagagaagtgagtgatgcataatgcatgaatgcatgaccgcgccaccatgactgttggatacgatgaggagatcccattcgagcaagttagggctcataacaagccagatgatgcttggtgtgctattcatggacacgtgtacgatgttaccaagttcgcttctgttcatccaggaggagatattatcttgctcgctgctggaaaggaagctactgtgctctacgagacctaccatgttagaggagtgtctgatgctgtgctcagaaagtacagaatcggaaagttgccagatggacaaggaggagctaacgagaaggagaagagaaccttgtctggattgtcctctgcttcttactacacctggaactccgatttctacagagtgatgagggagagagttgtggctagattgaaggagagaggaaaggctagaagaggaggatacgagttgtggatcaaggctttcttgctccttgttggattctggtcctctctttactggatgtgcaccctcgatccatctttcggagctatcttggctgctatgtctttgggagtgttcgctgcttttgttggaacctgcatccaacatgatggaaaccatggagctttcgctcaatctagatgggttaacaaggtggcaggatggactttggatatgatcggagcttctggaatgacttgggagttccaacatgtgttgggacatcacccatacactaacttgatcgaggaggagaacggattgcaaaaggtgtccggaaagaagatggataccaagttggctgatcaagagtctgatccagatgtgttctccacctacccaatgatgagattgcatccatggcatcagaagagatggtatcacaggttccagcatatctacggaccattcatcttcggattcatgaccatcaacaaggtggtgactcaagatgttggagtggtgttgagaaagaggctcttccaaatcgatgctgagtgcagatatgcttccccaatgtacgttgctaggttctggatcatgaaggctttgaccgtgttgtacatggttgctctcccatgttatatgcaaggaccatggcatggattgaagctcttcgctatcgctcatttcacttgcggagaggttttggctaccatgttcatcgtgaaccacattatcgagggagtgtcttacgcttctaaggatgctgttaagggaactatggctccaccaaagactatgcatggagtgaccccaatgaacaacactagaaaggaggttgaggctgaggcttctaagtctggagctgtggttaagtctgtgccattggatgattgggctgctgttcaatgccaaacctctgtgaactggtctgttggatcttggttctggaaccatttctctggaggactcaaccatcaaatcgagcatcatctcttcccaggattgtctcacgagacctactaccacatccaagatgtggttcaatctacctgtgctgagtacggagttccataccaacatgagccatctttgtggactgcttactggaagatgctcgaacatttgagacaattgggaaacgaggagactcacgagtcttggcaaagagctgcttgattaattaactaagactcccaaaaccaccttccctgtgacagttaaaccctgcttatacctttcctcctaataatgttcatctgtcacacaaactaaaataaataaaatgggagcaataaataaaatgggagctcatatatttacaccatttacactgtctattattcaccatgccaattattacttcataattttaaaattatgtcatttttaaaaattgcttaatgatggaaaggattattataagttaaaagtataacatagataaactaaccacaaaacaaatcaatataaactaacttactctcccatctaatttttatttaaatttctttacacttctcttccatttctatttctacaacattatttaacatttttattgtatttttcttactttctaactctattcatttcaaaaatcaatatatgtttatcaccacctctctaaaaaaaactttacaatcattggtccagaaaagttaaatcacgagatggtcattttagcattaaaacaacgattcttgtatcactatttttcagcatgtagtccattctcttcaaacaaagacagcggctatataatcgttgtgttatattcagtctaaaacaaggcgcctactaccggtaattcccgggattagcggccgctagtctgtgcgcacttgtatcctgcaggtcaatcgtttaaacactgtacggaccgtggcctaataggccggtacccaactttattatacatagttgataattcactggccggatgtaccgaattcgcggccgcaagcttgtacactagtacgcgtcaattggcgatcgcagtacttaatcagtgatcagtaactaaattcagtacattaaagacgtccgcaatgtgttattaagttgtctaagcgtcaatttgtttacaccacaatatatcctgccaccagccagccaacagctccccgaccggcagctcggcacaaaatcactgatcatctaaaaaggtgatgtgtatttgagtaaaacagcttgcgtcatgcggtcgctgcgtatatgatgcgatgagtaaataaacaaatacgcaaggggaacgcatgaaggttatcgctgtacttaaccagaaaggcgggtcaggcaagacgaccatcgcaacccatctagcccgcgccctgcaactcgccggggccgatgttctgttagtcgattccgatccccagggcagtgcccgcgattgggcggccgtgcgggaagatcaaccgctaaccgttgtcggcatcgaccgcccgacgattgaccgcgacgtgaaggccatcggccggcgcgacttcgtagtgatcgacggagcgccccaggcggcggacttggctgtgtccgcgatcaaggcagccgacttcgtgctgattccggtgcagccaagcccttacgacatttgggccaccgccgacctggtggagctggttaagcagcgcattgaggtcacggatggaaggctacaagcggcctttgtcgtgtcgcgggcgatcaaaggcacgcgcatcggcggtgaggttgccgaggcgctggccgggtacgagctgcccattcttgagtcccgtatcacgcagcgcgtgagctacccaggcactgccgccgccggcacaaccgttcttgaatcagaacccgagggcgacgctgcccgcgaggtccaggcgctggccgctgaaattaaatcaaaactcatttgagttaatgaggtaaagagaaaatgagcaaaagcacaaacacgctaagtgccggccgtccgagcgcacgcagcagcaaggctgcaacgttggccagcctggcagacacgccagccatgaagcgggtcaactttcagttgccggcggaggatcacaccaagctgaagatgtacgcggtacgccaaggcaagaccattaccgagctgctatctgaatacatcgcgcagctaccagagtaaatgagcaaatgaataaatgagtagatgaattttagcggctaaaggaggcggcatggaaaatcaagaacaaccaggcaccgacgccgtggaatgccccatgtgtggaggaacgggcggttggccaggcgtaagcggctgggttgtctgccggccctgcaatggcactggaacccccaagcccgaggaatcggcgtgagcggtcgcaaaccatccggcccggtacaaatcggcgcggcgctgggtgatgacctggtggagaagttgaaggccgcgcaggccgcccagcggcaacgcatcgaggcagaagcacgccccggtgaatcgtggcaaggggccgctgatcgaatccgcaaagaatcccggcaaccgccggcagccggtgcgccgtcgattaggaagccgcccaagggcgacgagcaaccagattttttcgttccgatgctctatgacgtgggcacccgcgatagtcgcagcatcatggacgtggccgttttccgtctgtcgaagcgtgaccgacgagctggcgaggtgatccgctacgagcttccagacgggcacgtagaggtttccgcaggccccgccggcatggccagtgtgtgggattacgacctggtactgatggcggtttcccatctaaccgaatccatgaaccgataccgggaagggaagggagacaagcccggccgcgtgttccgtccacacgttgcggacgtactcaagttctgccggcgagccgatggcggaaagcagaaagacgacctggtagaaacctgcattcggttaaacaccacgcacgttgccatgcagcgtaccaagaaggccaagaacggccgcctggtgacggtatccgagggtgaagccttgattagccgctacaagatcgtaaagagcgaaaccgggcggccggagtacatcgagatcgagcttgctgattggatgtaccgcgagatcacagaaggcaagaacccggacgtgctgacggttcaccccgattactttttgatcgaccccggcatcggccgttttctctaccgcctggcacgccgcgccgcaggcaaggcagaagccagatggttgttcaagacgatctacgaacgcagtggcagcgccggagagttcaagaagttctgtttcaccgtgcgcaagctgatcgggtcaaatgacctgccggagtacgatttgaaggaggaggcggggcaggctggcccgatcctagtcatgcgctaccgcaacctgatcgagggcgaagcatccgccggttcctaatgtacggagcagatgctagggcaaattgccctagcaggggaaaaaggtcgaaaaggtctctttcctgtggatagcacgtacattgggaacccaaagccgtacattgggaaccggaacccgtacattgggaacccaaagccgtacattgggaaccggtcacacatgtaagtgactgatataaaagagaaaaaaggcgatttttccgcctaaaactctttaaaacttattaaaactcttaaaacccgcctggcctgtgcataactgtctggccagcgcacagccgaagagctgcaaaaagcgcctacccttcggtcgctgcgctccctacgccccgccgcttcgcgtcggcctatcgcggcctatgcggtgtgaaataccgcacagatgcgtaaggagaaaataccgcatcaggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtccttcaactcatcgatagtttggctgtgagcaattatgtgcttagtgcatctaacgcttgagttaagccgcgccgcgaagcggcgtcggcttgaacgaatttctagctagacattatttgccaacgaccttcgtgatctcgcccttgacatagtggacaaattcttcgagctggtcggcccgggacgcgagacggtcttcttcttggcccagataggcttggcgcgcttcgaggatcacgggctggtattgcgccggaaggcgctccatcgcccagtcggcggcgacatccttcggcgcgatcttgccggtaaccgccgagtaccaaatccggctcagcgtaaggaccacattgcgctcatcgcccgcccaatccggcggggagttccacagggtcagcgtctcgttcagtgcttcgaacagatcctgttccggcaccgggtcgaaaagttcctcggccgcggggccgacgagggccacgctatgctcccgggccttggtgagcaggatcgccagatcaatgtcgatggtggccggttcaaagatacccgccagaatatcattacgctgccattcgccgaactggagttcgcgtttggccggatagcgccaggggatgatgtcatcgtgcaccacaatcgtcacctcaaccgcgcgcaggatttcgctctcgccgggggaggcggacgtttccagaaggtcgttgataagcgcgcggcgcgtggtctcgtcgagacggacggtaacggtgacaagcaggtcgatgtccgaatggggcttaaggccgccgtcaacggcgctaccatacagatgcacggcgaggagggtcggttcgaggtggcgctcgatgacacccacgacttccgacagctgggtggacacctcggcgatgaccgcttcacccatgatgtttaactttgttttagggcgactgccctgctgcgtaacatcgttgctgctccataacatcaaacatcgacccacggcgtaacgcgcttgctgcttggatgcccgaggcatagactgtaccccaaaaaaacagtcataacaagccatgaaaaccgccactgcgttccatgaatattcaaacaaacacatacagcgcgacttatcatggata

SEQ ID NO: 9 - DNA, 21639 bp, Artificial Sequence
  plasmid
ttgacatacaaatggacgaacggataaaccttttcacgcccttttaaatatccgattattctaataaacgctcttttctcttaggtttacccgccaatatatcctgtcaaacactgatagtttaaactgaaggcgggaaacgacaatctgatcactgattagtaactaaggcctttaattaatctagaggcgcgccgggccccctgcagggagctcggccggccaatttaaattgatatcggtacatcgattacgccaagctatcaactttgtatagaaaagttgccatgattacgccaagcttggccactaaggccaatttaaatctactaggccggcctgctcggcccggactgtatccaacttgagatctttgaatctctctgttccttgatgttctgaaggagttctaagtgtaatcagaaagcttgtaacatgctttgtagactttctttgatatactcttgcaatgactgattgaacctacgtgaaaactgctggtcaagttctaaccaaattccgtctacggaaggcccaaaatttattgacatcttcagtttcatggacgtgtcttcaaagttttataacttcttatcccatcatttttaagtctagttctgttccgcatagtcttagatctcaaacaaatctacaactcttgtgtcagttcttcttccagaatcaacttgctacatggtgaaaatctggcgtcaagttctgaacttgtcaattttcttaacagttagaaaataatctaagtgtttagaatattgacttttccaaagcaaagaagacttttgactttcttaataaaacaaacttctaattctaacatgtcttgatgaaatgtctttcttgaaatttgatcaagatgcaaaagtcaaagtttgacttttcagactgcaattgaccattttgcagaagtgccaattccaaaccaaaattgatgatacagtgctgcaaacttgatgtcatggaagatcttaacagaaaattcttgaagactgagagcaaaaattttcatgtacaacacaaactttcctgtttttcatagtcgctgtagacacattaacataaaacacctgatcattcgaagagtgattcttgaaggaaatgtgcagttacctttgtgcagaacttaagagcaacttacagactcatttactaaaatactacaatcaggaagattttaacaacttacagaagtattcggagttaaagagcaacacattaagggcgacagttaaaattaatgtgttgtaaccaccactacgaatagtaagtattataagttaaatgtaatcatcacattataattattgtccttataattaattatgataaacatgtatcattaagattgtcataaccaaatagtcctcgacttgatttttgaattattgtattctatgttacttttcttgtagcctatataaaaactttgtaaagcataattgtatgctggaaaaaatactgtaatgaattgaatagaaattatggtatttcattctccaaaatccatcaatagaaatttagtacaaatcgaaagacaaaaatattgacttattttaaattttacaacaatataaaaatattgacttattttaaattttacaataatataaattttcacctgtcacctttagaaatccaccaacaatattaattcttagataaattattcttaataattttgagatctctgtaattatctgatatttattttatatttgtcagttattttcttatgttttactgttaacccttatatcttggtcaaactagaataagtaaatatgagtttgtgaaggacacattgacaagatgaaacattggttttttccttcttcgaatgttaaaggtaataaaacattcagaatattgacctactattaatatagatcctttgtcttttaaaaaagtgtgcatgaaaatgctcttaggtaagctagtgtctcttgcagggctgtgtatatcaattccatttccagatggttgtaactgccactacctataattagtcataagacacgtatgttaacacacgtccccatgcatgttttttgccatatattcccacactttctttttcttcacgtataaaacattgaactaattaatagtccgatcaagctgaacaccgcgccaccatgatcactactactcacagagttcacgaggctccagttaagactagacttaccgctgttgctgatgttaggcctatccctgacgttaagacccttaaggacgctatccctgctaagtgcttcgagagatctatgttgagatctttcagctacgttgttagggatctcatcgttgttttctcccttttctacgctgctgttccactttctagacttgacgctccttggtttgttactgttcctctttgggctctctactctttcgttcagggatgcttcttcactggactttggattcttgctcacgattgcggacacgattctttctctgaaaacctcaccgttaacgctatcactggatggttccttcactgcatgcttatggtgcctttcttctcctggaaattctctcacgctagacaccacagataccacaaccacatggataaggataccgttttcgttcctcacagaaagtctgacgtggaggccaagaaaactaagcctactctcctcgagaagatcatggatcactctgctgctgatactcctatcatcaccgttgcttctcttatcttccaccaagttcttggatggcctgcttacattcttatgaacgctggtgctggaaagaagtctcttaccaagggagataggtacacctcttctaggtacaagcagtctcaccttgatcctactgctcacgttttcactccatctgaggctccattcgttgctttgtctaatgttggactcatccttactatgaccgctctctatgtttggtcaagatctgttggaacctctaccgttcttcttgcttacggacttccttacctttggatgaatcactggatcgttgctatcacttaccttcaccacactcaccctgaggctcctcactacgaggctgataactggactttcatcaagggtgctgcttcaactgttgatagggacttcggattcatcggtagacatatcttccacggaattatcgagtaccacgttgttcaccacatgttccctagaatcccattctaccacgctgaggaagctacttgggctatcgctccacttcttggagagcgttacatccagcaaaagaccaacttcttcggagatctttggcagtctttcactacttgcaagactgttgagcctggaactggtgttcacgcaggtggacttgtttggtctaagaccaaggctaagaaggatgctaagaagtccgactgatagttaattaaggccgcctcgaccgtaccccctgcagatagactatactatgttttagcctgcctgctggctagctactatgttatgttatgttgtaaaataaacacctgctaaggtatatctatctatattttagcatggctttctcaataaattgtctttccttatcgtttactatcttatacctaataatgaaataataatatcacatatgaggaacggggcaggtttaggcatatatatacgagtgtagggcggagtggggggcgcctactaccggtaattcccgggattagcggccgctagtctgtgcgcacttgtatcctgcaggtcaatcgtttaaacactgtacggaccgtggcctaataggccggtacccaagtttgtacaaaaaagcaggctccatgattacgccaagcttggccactaaggccaatttaaatctactaggccggccaaagctttacaacgctacacaaaacttataaccgtaatcaccattcattaacttaactactatcacatgcattcatgaattgaaacgagaaggatgtaaatagttgggaagttatctccacgttgaagagatcgttagcgagagctgaaagaccgagggaggagacgccgtcaacacggacagagtcgtcgaccctcacatgaagtaggaggaatctccgtgaggagccagagagacgtctttggtcttcggtttcgatccttgatctgacggagaagacgagagaagtgcgactggactccgtgaggaccaacagagtcgtcctcggtttcgatcgtcggtattggtggagaaggcggaggaatctccgtgacgagccagagagatgtcgtcggtcttcggtttcgatccttgatctgacggagaagacgagagaagtgcgacgagactccgtgaggaccaacagagttgtcctcggtttcgatcgtcggtttcggcggagaaggcggaggaatctccgtgaggagccagagagacgtcgttggtcttcggtttcgatccttgatctgttggagaagacgagacaagtgggacgagactcaacgacggagtcagagacgtcgtcggtcttcggtttcggccgagaaggcggagtcggtcttcggtttcggccgagaaggcggaggagacgtcttcgatttgggtctctcctcttgacgaagaaaacaaagaacacgagaaataatgagaaagagaacaaaagaaaaaaaaataaaaataaaaataaaatttggtcctcttatgtggtgacacgtggtttgaaacccaccaaataatcgatcacaaaaaacctaagttaaggatcggtaataacctttctaattaattttgatttatattaaatcactctttttatttataaaccccactaaattatgcgatattgattgtctaagtacaaaaattctctcgaattcaatacacatgtttcatatatttagccctgttcatttaatattactagcgcatttttaatttaaaattttgtaaacttttttggtcaaagaacatttttttaattagagacagaaatctagactctttatttggaataatagtaataaagatatattaggcaatgagtttatgatgttatgtttatatagtttatttcattttaaattgaaaagcattatttttatcgaaatgaatctagtatacaatcaatatttatgttttttcatcagatactttcctattttttggcacctttcatcggactactgatttatttcaatgtgtatgcatgcatgagcatgagtatacacatgtcttttaaaatgcatgtaaagcgtaacggaccacaaaagaggatccatacaaatacatctcatcgcttcctctactattctccgacacacacactgagcatggtgcttaaacactctggtgagttctagtacttctgctatgatcgatctcattaccatttcttaaatttctctccctaaatattccgagttcttgatttttgataacttcaggttttctctttttgataaatctggtctttccatttttttttttttgtggttaatttagtttcctatgttcttcgattgtattatgcatgatctgtgtttggattctgttagattatgtattggtgaatatgtatgtgtttttgcatgtctggttttggtcttaaaaatgttcaaatctgatgatttgattgaagcttttttagtgttggtttgattcttctcaaaactactgttaatttactatcatgttttccaactttgattcatgatgacacttttgttctgctttgttataaaattttggttggtttgattttgtaattatagtgtaattttgttaggaatgaacatgttttaatactctgttttcgatttgtcacacattcgaattattaatcgataatttaactgaaaattcatggttctagatcttgttgtcatcagattatttgtttcgataattcatcaaatatgtagtccttttgctgatttgcgactgtttcattttttctcaaaattgttttttgttaagtttatctaacagttatcgttgtcaaaagtctctttcattttgcaaaatcttctttttttttttgtttgtaactttgttttttaagctacacatttagtctgtaaaatagcatcgaggaacagttgtcttagtagacttgcatgttcttgtaacttctatttgtttcagtttgttgatgactgctttgattttgtaggtcaaaccgcgccatgtctgctagcggagctttgttgcctgctatagctttcgctgcttacgcttacgctacctacgcttatgctttcgagtggagccacgctaacggaatcgataacgtggatgctagagagtggattggagctttgtctttgagactccctgcaattgcaaccacaatgtacctcttgttctgccttgtgggacctagattgatggctaagagggaggcttttgatcctaagggatttatgctcgcttacaacgcttaccaaaccgctttcaacgttgtggtgctcggaatgttcgctagagagatctctggattgggacaacctgtttggggatctactatgccttggagcgataggaagtccttcaagattttgttgggagtgtggctccactacaacaataagtacctcgagttgttggatactgtgttcatggtggctaggaaaaagaccaagcagctctctttcttgcacgtgtaccaccacgctttgttgatttgggcttggtggcttgtttgtcacctcatggctaccaacgattgcatcgatgcttatttcggagctgcttgcaactctttcatccacatcgtgatgtactcctactacctcatgtctgctttgggaattaggtgcccttggaagagatatatcacccaggctcagatgttgcaattcgtgatcgtgttcgctcacgctgttttcgtgctcagacaaaagcactgccctgttactttgccttgggcacaaatgttcgtgatgacaaatatgttggtgctcttcggaaacttctacctcaaggcttactctaacaagtctaggggagatggagcttcttctgttaagcctgctgagactactagagcaccttctgtgagaagaaccaggtcaaggaagatcgattgatagttaattaactaagtttgatgtatctgagtgccaacgtttactttgtctttcctttcttttattggttatgattagatgtttactatgttctctctttttcgttataaataaagaagttcaattcttctatagtttcaaacgcgattttaagcgtttctatttaggtttacatgatttcttttacaaaatcatctttaaaatacagtatatttttagttttcataaaatatttaaagaaatgaaagtttataaacattcactcctattctctaattaaggatttgtaaaacaaaaattttgtaagcatatcgatttatgcgttttgtcttaattagctcactaaataataaataatagcttatgttgtgggactgtttaattacctaacttagaactaaaatcaactctttgtgggcgcctactaccggtaattcccgggattagcggccgctagtctgtgcgcacttgtatcctgcaggttaggccggccactgcagcaaatttacacattgccactaaacgtctaaacccttgtaatttgtttttgttttactatgtgtgttatgtatttgatttgcgataaatttttatatttggtactaaatttataacaccttttatgctaacgtttgccaacacttagcaatttgcaagttgattaattgattctaaattatttttgtcttctaaatacatatactaatcaactggaaatgtaaatatttgctaatatttctactataggagaattaaagtgagtgaatatggtaccacaaggtttggagatttaattgttgcaatgctgcatggatggcatatacaccaaacattcaataattcttgaggataataatggtaccacacaagatttgaggtgcatgaacgtcacgtggacaaaaggtttagtaatttttcaagacaacaatgttaccacacacaagttttgaggtgcatgcatggatgccctgtggaaagtttaaaaatattttggaaatgatttgcatggaagccatgtgtaaaaccatgacatccacttggaggatgcaataatgaagaaaactacaaatttacatgcaactagttatgcatgtagtctatataatgaggattttgcaatactttcattcatacacactcactaagttttacacgattataatttcttcatagccagtagggtttcgtttttgtttcatcgataaactcaaaggtgatgattttagggtcttgtgagtgtgcttttttgtttgattctactgtagggtttatgttctttagctcataggttttgtgtatttcttagaaatgtggcttctttaatctctgggtttgtgactttttgtgtggtttctgtgtttttcatatcaaaaacctattttttccgagtttttttttacaaattcttactctcaagcttgaatacttcacatgcagtgttcttttgtagattttagagttaatgtgttaaaaagtttggatttttcttgcttatagagcttcttcactttgattttgtgggtttttttgttttaaaggtgagatttttgatgaggtttttgcttcaaagatgtcacctttctgggtttgtcttttgaataaagctatgaactgtcacatggctgacgcaattttgttactatgtcatgaaagctgacgtttttccgtgttatacatgtttgcttacacttgcatgcgtcaaaaaaattggggctttttagttttagtcaaagattttacttctcttttgggatttatgaaggaaagttgcaaactttctcaaattttaccatttttgctttgatgtttgtttagattgcgacagaacaaactcatatatgttgaaatttttgcttggttttgtataggattgtgtcttttgcttataaatgttgaaatctgaactttttttttgtttggtttctttgagcaggagataaggcgcgccttccatggctacaaaggaggcttacgttttcccaactctcaccgagatcaagagatctctcccaaaggattgcttcgaggcttctgtgcctttgtctctctactacactgtgagatgcttggttattgctgtggctttgaccttcggattgaactacgctagagctttgccagaggttgagtctttctgggctttggatgctgctttgtgcactggatatatcctcctccagggaattgtgttctggggattcttcactgttggacacgatgctggacacggagctttctctagataccacctcttgaacttcgttgtgggaaccttcatgcactctctcatcttgaccccattcgagtcttggaagttgacccacagacaccaccacaagaacaccggaaacatcgatagagatgaggtgttctacccacagagaaaggctgatgatcacccattgtccaggaacttgatcttggctttgggagctgcttggcttgcttatttggtggagggattcccaccaagaaaggtgaaccacttcaacccattcgagccactttttgtgagacaagtgtccgctgtggttatctctttgctcgctcacttcttcgttgctggactctctatctacttgtctctccagttgggacttaagaccatggctatctactactacggaccagttttcgtgttcggatctatgttggtgattaccaccttcttgcaccacaacgatgaggagactccatggtatgctgattctgagtggacttacgtgaagggaaacttgtcctctgtggatagatcttacggtgctctcatcgataacctctcccacaacatcggaactcaccagatccaccacctcttcccaattatcccacactacaagctcaagaaggctactgctgctttccaccaagctttcccagagcttgtgagaaagtccgatgagccaatcatcaaggctttcttcagagtgggaaggttgtatgctaactacggagtggttgatcaagaggctaagctcttcactttgaaggaggctaaggctgctactgaagctgctgctaagaccaagtctacctgattaattaaggccgcagatctccaccgcggtggcgctctagcccgatatctcgacaagctcgagtttctccataataatgtgtgagtagttcccagataagggaattagggttcctatagggtttcgctcatgtgttgagcatataagaaacccttagtatgtatttgtatttgtaaaatacttctatcaataaaatttctaattcctaaaaccaaaatccagtactaaaatccagatcccccgaattaattcggcgttaattcagggcaaacactgtacggaccgtggcctaataggccggtaccacccagctttcttgtacaaagtggccatgattacgccaagcttggccactaaggccaatttaaatctactaggccggcctactatagaaaatgtgttatatcgacatgaccagacaaaggggcaacagttaacaaaacaattaattctttcatttgagattaaggaaggtaaggtactaaaaagattaaaaaaaatgagcttatctctttgtttctgtaataataatataagtgtgataaacttttaatataataattgtaattaggttttctacagatgagcaccactcagagacaagataagaagaaaacaattttgttaaacatgattatagaaacttttagttaagtcttgaagtatcaatataacaaaaaaaagtacacacgactatgacaataaacccactaccgtcaggttatcatttcgatgaaatgttttgatatcattaaatataacagtcacaaaaaatcatctaattataacaatataacttatacatatatttaactaaaaacttagagtttttgtaatgattctaattgatgattagagtttatagaaatacaattaaataaaaaatataattttaaaaaaacatagtaaagtcaatgagatcctctctgacctcagtgatcatttagtcatgtatgtacaacaatcattgttcatcacatgactgtaaaataaataaggataaacttgggaatatatataatatattgtattaaataaaaaagggaaatacaaatatcaattttagattcccgagttgacacaactcaccatgcacgctgccacctcagctcccagctctcgtcacatgtctcatgtcagttaggtctttggtttttagtctttgacacaactcgccatgcatgttgccacgtgagctcgttcctcttcccatgatctcaccactgggcatgcatgctgccacctcagctggcacctcttctctatatgtccctagaggccatgcacagtgccacctcagcactcctctcagaacccatacgtacctgccaatcggcttctctccataaatatctatttaaattataactaattatttcatatacttaattgatgacgtggatgcattgccatcgttgtttaataattgttaattacgacatgataaataaaatgaaagtaaaaagtacgaaagattttccatttgttgttgtataaatagagaagtgagtgatgcataatgcatgaatgcatgaccgcgccaccatgactgttggatacgatgaggagatcccattcgagcaagttagggctcataacaagccagatgatgcttggtgtgctattcatggacacgtgtacgatgttaccaagttcgcttctgttcatccaggaggagatattatcttgctcgctgctggaaaggaagctactgtgctctacgagacctaccatgttagaggagtgtctgatgctgtgctcagaaagtacagaatcggaaagttgccagatggacaaggaggagctaacgagaaggagaagagaaccttgtctggattgtcctctgcttcttactacacctggaactccgatttctacagagtgatgagggagagagttgtggctagattgaaggagagaggaaaggctagaagaggaggatacgagttgtggatcaaggctttcttgctccttgttggattctggtcctctctttactggatgtgcaccctcgatccatctttcggagctatcttggctgctatgtctttgggagtgttcgctgcttttgttggaacctgcatccaacatgatggaaaccatggagctttcgctcaatctagatgggttaacaaggtggcaggatggactttggatatgatcggagcttctggaatgacttgggagttccaacatgtgttgggacatcacccatacactaacttgatcgaggaggagaacggattgcaaaaggtgtccggaaagaagatggataccaagttggctgatcaagagtctgatccagatgtgttctccacctacccaatgatgagattgcatccatggcatcagaagagatggtatcacaggttccagcatatctacggaccattcatcttcggattcatgaccatcaacaaggtggtgactcaagatgttggagtggtgttgagaaagaggctcttccaaatcgatgctgagtgcagatatgcttccccaatgtacgttgctaggttctggatcatgaaggctttgaccgtgttgtacatggttgctctcccatgttatatgcaaggaccatggcatggattgaagctcttcgctatcgctcatttcacttgcggagaggttttggctaccatgttcatcgtgaaccacattatcgagggagtgtcttacgcttctaaggatgctgttaagggaactatggctccaccaaagactatgcatggagtgaccccaatgaacaacactagaaaggaggttgaggctgaggcttctaagtctggagctgtggttaagtctgtgccattggatgattgggctgctgttcaatgccaaacctctgtgaactggtctgttggatcttggttctggaaccatttctctggaggactcaaccatcaaatcgagcatcatctcttcccaggattgtctcacgagacctactaccacatccaagatgtggttcaatctacctgtgctgagtacggagttccataccaacatgagccatctttgtggactgcttactggaagatgctcgaacatttgagacaattgggaaacgaggagactcacgagtcttggcaaagagctgcttgattaattaactaagactcccaaaaccaccttccctgtgacagttaaaccctgcttatacctttcctcctaataatgttcatctgtcacacaaactaaaataaataaaatgggagcaataaataaaatgggagctcatatatttacaccatttacactgtctattattcaccatgccaattattacttcataattttaaaattatgtcatttttaaaaattgcttaatgatggaaaggattattataagttaaaagtataacatagataaactaaccacaaaacaaatcaatataaactaacttactctcccatctaatttttatttaaatttctttacacttctcttccatttctatttctacaacattatttaacatttttattgtatttttcttactttctaactctattcatttcaaaaatcaatatatgtttatcaccacctctctaaaaaaaactttacaatcattggtccagaaaagttaaatcacgagatggtcattttagcattaaaacaacgattcttgtatcactatttttcagcatgtagtccattctcttcaaacaaagacagcggctatataatcgttgtgttatattcagtctaaaacaaggcgcctactaccggtaattcccgggattagcggccgctagtctgtgcgcacttgtatcctgcaggttaggccggccattagcagatatttggtgtctaaatgtttattttgtgatatgttcatgtttgaaatggtggtttcgaaaccagggacaacgttgggatctgatagggtgtcaaagagtattatggattgggacaatttcggtcatgagttgcaaattcaagtatatcgttcgattatgaaaattttcgaagaatatcccatttgagagagtctttacctcattaatgtttttagattatgaaattttatcatagttcatcgtagtctttttggtgtaaaggctgtaaaaagaaattgttcacttttgttttcgtttatgtgaaggctgtaaaagattgtaaaagactattttggtgttttggataaaatgatagtttttatagattcttttgcttttagaagaaatacatttgaaattttttccatgttgagtataaaataccgaaatcgattgaagatcatagaaatattttaactgaaaacaaatttataactgattcaattctctccatttttatacctatttaaccgtaatcgattctaatagatgatcgattttttatataatcctaattaaccaacggcatgtattggataattaaccgatcaactctcacccctaatagaatcagtattttccttcgacgttaattgatcctacactatgtaggtcatatccatcgttttaatttttggccaccattcaattctgtcttgcctttagggatgtgaatatgaacggccaaggtaagagaataaaaataatccaaattaaagcaagagaggccaagtaagataatccaaatgtacacttgtcattgccaaaattagtaaaatactcggcatattgtattcccacacattattaaaataccgtatatgtattggctgcatttgcatgaataatactacgtgtaagcccaaaagaacccacgtgtagcccatgcaaagttaacactcacgaccccattcctcagtctccactatataaacccaccatccccaatctcaccaaacccaccacacaactcacaactcactctcacaccttaaagaaccaatcaccaccaaaaaaccgcgccaccatgcttgttcttttcggaaacttctacgtgaagcagtactctcaaaagaacggaaagcctgagaacggtgctactcctgaaaacggtgcaaagcctcaaccttgtgagaacggaactgttgagaagagggagaacgataccgctaatgttagacctactagaccagctggacctcctcctgctacttactacgattctctcgctgtttctggacagggaaaagagagacttttcaccaccgacgaagttagaaggcacatcctccctactgacggatggcttacttgtcacgagggagtttacgacgttactgacttccttgcaaaacaccctggtggaggtgttatcactcttggactcggaagagattgcactatcctcatcgagtcttaccaccctgctggtagacctgataaggtgatggaaaagtaccgtatcggaactcttcaagaccctaagactttctacgcttggggagagtctgatttctaccctgagcttaagagaagggctcttgctagacttaaagaggctggacaagctagaagaggtggacttggagttaaggctctccttgttcttactctcttcttcgtgtcttggtatatgtgggttgcacacaagtctttcttgtgggctgctgtttggggattcgctggatcacatgtgggactttctatccagcacgacggaaaccacggtgctttctctagaaacaccctcgttaacagacttgctggatggggaatggatcttatcggagcttcttctactgtttgggagtaccagcacgttatcggacaccaccagtacactaacctcgtttctgatacccttttcagccttcctgagaacgatcctgatgtgttctcttcttaccctctcatgagaatgcaccctgatactgcttggcaacctcaccacagattccagcaccttttcgctttccctttgttcgctctcatgaccatctctaaggttctcacctctgatttcgctgtttgcctctctatgaagaagggatctatcgattgctctagcagacttgttcctcttgagggacaacttcttttctggggtgctaaacttgctaacttcctcctccaaatcgttcttccttgttaccttcacggaactgctatgggacttgctcttttctctgttgctcaccttgtttctggtgagtaccttgctatctgcttcatcatcaaccacatctctgagtcttgtgagttcatgaacacctcattccaaactgctgctagaagaactgagatgcttcaagctgctcatcaagctgctgaggctaagaaggttaagcctactcctcctcctaacgattgggctgttactcaagttcagtgctgtgttaactggcgttctggtggagttcttgctaaccacctttctggtggacttaaccaccagatcgagcaccacctcttcccttctatctctcacgctaactaccctactatcgctcctgttgtgaaagaagtgtgcgaggaatacggacttccttacaagaactacgtgaccttctgggatgctgtttgtggaatggttcagcaccttagacttatgggtgctcctcctgttcctactaacggtgacaaaaaaagttgatgattaattaataattgattgctgctttaatgagatatgcgagacgcctatgatcgcatgatatttgctttcaattctgttgtgcacgttgtaaaaaacctgagcatgtgtagctcagatccttaccgccggtttcggttcattctaatgaatatatcacccgttactatcgtatttttatgaataatattctccgttcaatttactgattgtggcaaacactgtacggaccgtggcctaataggccggtacccaactttattatacatagttgataattcactggccggatgtaccgaattcgcggccgcaagcttgtacactagtacgcgtcaattggcgatcgcagtacttaatcagtgatcagtaactaaattcagtacattaaagacgtccgcaatgtgttattaagttgtctaagcgtcaatttgtttacaccacaatatatcctgccaccagccagccaacagctccccgaccggcagctcggcacaaaatcactgatcatctaaaaaggtgatgtgtatttgagtaaaacagcttgcgtcatgcggtcgctgcgtatatgatgcgatgagtaaataaacaaatacgcaaggggaacgcatgaaggttatcgctgtacttaaccagaaaggcgggtcaggcaagacgaccatcgcaacccatctagcccgcgccctgcaactcgccggggccgatgttctgttagtcgattccgatccccagggcagtgcccgcgattgggcggccgtgcgggaagatcaaccgctaaccgttgtcggcatcgaccgcccgacgattgaccgcgacgtgaaggccatcggccggcgcgacttcgtagtgatcgacggagcgccccaggcggcggacttggctgtgtccgcgatcaaggcagccgacttcgtgctgattccggtgcagccaagcccttacgacatttgggccaccgccgacctggtggagctggttaagcagcgcattgaggtcacggatggaaggctacaagcggcctttgtcgtgtcgcgggcgatcaaaggcacgcgcatcggcggtgaggttgccgaggcgctggccgggtacgagctgcccattcttgagtcccgtatcacgcagcgcgtgagctacccaggcactgccgccgccggcacaaccgttcttgaatcagaacccgagggcgacgctgcccgcgaggtccaggcgctggccgctgaaattaaatcaaaactcatttgagttaatgaggtaaagagaaaatgagcaaaagcacaaacacgctaagtgccggccgtccgagcgcacgcagcagcaaggctgcaacgttggccagcctggcagacacgccagccatgaagcgggtcaactttcagttgccggcggaggatcacaccaagctgaagatgtacgcggtacgccaaggcaagaccattaccgagctgctatctgaatacatcgcgcagctaccagagtaaatgagcaaatgaataaatgagtagatgaattttagcggctaaaggaggcggcatggaaaatcaagaacaaccaggcaccgacgccgtggaatgccccatgtgtggaggaacgggcggttggccaggcgtaagcggctgggttgtctgccggccctgcaatggcactggaacccccaagcccgaggaatcggcgtgagcggtcgcaaaccatccggcccggtacaaatcggcgcggcgctgggtgatgacctggtggagaagttgaaggccgcgcaggccgcccagcggcaacgcatcgaggcagaagcacgccccggtgaatcgtggcaaggggccgctgatcgaatccgcaaagaatcccggcaaccgccggcagccggtgcgccgtcgattaggaagccgcccaagggcgacgagcaaccagattttttcgttccgatgctctatgacgtgggcacccgcgatagtcgcagcatcatggacgtggccgttttccgtctgtcgaagcgtgaccgacgagctggcgaggtgatccgctacgagcttccagacgggcacgtagaggtttccgcaggccccgccggcatggccagtgtgtgggattacgacctggtactgatggcggtttcccatctaaccgaatccatgaaccgataccgggaagggaagggagacaagcccggccgcgtgttccgtccacacgttgcggacgtactcaagttctgccggcgagccgatggcggaaagcagaaagacgacctggtagaaacctgcattcggttaaacaccacgcacgttgccatgcagcgtaccaagaaggccaagaacggccgcctggtgacggtatccgagggtgaagccttgattagccgctacaagatcgtaaagagcgaaaccgggcggccggagtacatcgagatcgagcttgctgattggatgtaccgcgagatcacagaaggcaagaacccggacgtgctgacggttcaccccgattactttttgatcgaccccggcatcggccgttttctctaccgcctggcacgccgcgccgcaggcaaggcagaagccagatggttgttcaagacgatctacgaacgcagtggcagcgccggagagttcaagaagttctgtttcaccgtgcgcaagctgatcgggtcaaatgacctgccggagtacgatttgaaggaggaggcggggcaggctggcccgatcctagtcatgcgctaccgcaacctgatcgagggcgaagcatccgccggttcctaatgtacggagcagatgctagggcaaattgccctagcaggggaaaaaggtcgaaaaggtctctttcctgtggatagcacgtacattgggaacccaaagccgtacattgggaaccggaacccgtacattgggaacccaaagccgtacattgggaaccggtcacacatgtaagtgactgatataaaagagaaaaaaggcgatttttccgcctaaaactctttaaaacttattaaaactcttaaaacccgcctggcctgtgcataactgtctggccagcgcacagccgaagagctgcaaaaagcgcctacccttcggtcgctgcgctccctacgccccgccgcttcgcgtcggcctatcgcggcctatgcggtgtgaaataccgcacagatgcgtaaggagaaaataccgcatcaggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtccttcaactcatcgatagtttggctgtgagcaattatgtgcttagtgcatctaacgcttgagttaagccgcgccgcgaagcggcgtcggcttgaacgaatttctagctagacattatttgccaacgaccttcgtgatctcgcccttgacatagtggacaaattcttcgagctggtcggcccgggacgcgagacggtcttcttcttggcccagataggcttggcgcgcttcgaggatcacgggctggtattgcgccggaaggcgctccatcgcccagtcggcggcgacatccttcggcgcgatcttgccggtaaccgccgagtaccaaatccggctcagcgtaaggaccacattgcgctcatcgcccgcccaatccggcggggagttccacagggtcagcgtctcgttcagtgcttcgaacagatcctgttccggcaccgggtcgaaaagttcctcggccgcggggccgacgagggccacgctatgctcccgggccttggtgagcaggatcgccagatcaatgtcgatggtggccggttcaaagatacccgccagaatatcattacgctgccattcgccgaactggagttcgcgtttggccggatagcgccaggggatgatgtcatcgtgcaccacaatcgtcacctcaaccgcgcgcaggatttcgctctcgccgggggaggcggacgtttccagaaggtcgttgataagcgcgcggcgcgtggtctcgtcgagacggacggtaacggtgacaagcaggtcgatgtccgaatggggcttaaggccgccgtcaacggcgctaccatacagatgcacggcgaggagggtcggttcgaggtggcgctcgatgacacccacgacttccgacagctgggtggacacctcggcgatgaccgcttcacccatgatgtttaactttgttttagggcgactgccctgctgcgtaacatcgttgctgctccataacatcaaacatcgacccacggcgtaacgcgcttgctgcttggatgcccgaggcatagactgtaccccaaaaaaacagtcataacaagccatgaaaaccgccactgcgttccatgaatattcaaacaaacacatacagcgcgacttatcatggata

SEQ ID NO: 10 - DNA, 15517 bp, Artificial Sequence
  plasmid
ttgacatacaaatggacgaacggataaaccttttcacgcccttttaaatatccgattattctaataaacgctcttttctcttaggtttacccgccaatatatcctgtcaaacactgatagtttaaactgaaggcgggaaacgacaatctgatcactgattagtaactaaggcctttaattaatctagaggcgcgccgggccccctgcagggagctcggccggccaatttaaattgatatcggtacatcgattacgccaagctatcaactttgtatagaaaagttgccatgattacgccaagcttggccactaaggccaatttaaatctactaggccggccaaagtaggcgcctactaccggtaattcccgggattagcggccgctagtctgtgcgcacttgtatcctgcaggtcaatcgtttaaacactgtacggaccgtggcctaataggccggtacccaagtttgtacaaaaaagcaggctccatgattacgccaagcttggccactaaggccaatttaaatctactaggccggccaaagctttacaacgctacacaaaacttataaccgtaatcaccattcattaacttaactactatcacatgcattcatgaattgaaacgagaaggatgtaaatagttgggaagttatctccacgttgaagagatcgttagcgagagctgaaagaccgagggaggagacgccgtcaacacggacagagtcgtcgaccctcacatgaagtaggaggaatctccgtgaggagccagagagacgtctttggtcttcggtttcgatccttgatctgacggagaagacgagagaagtgcgactggactccgtgaggaccaacagagtcgtcctcggtttcgatcgtcggtattggtggagaaggcggaggaatctccgtgacgagccagagagatgtcgtcggtcttcggtttcgatccttgatctgacggagaagacgagagaagtgcgacgagactccgtgaggaccaacagagttgtcctcggtttcgatcgtcggtttcggcggagaaggcggaggaatctccgtgaggagccagagagacgtcgttggtcttcggtttcgatccttgatctgttggagaagacgagacaagtgggacgagactcaacgacggagtcagagacgtcgtcggtcttcggtttcggccgagaaggcggagtcggtcttcggtttcggccgagaaggcggaggagacgtcttcgatttgggtctctcctcttgacgaagaaaacaaagaacacgagaaataatgagaaagagaacaaaagaaaaaaaaataaaaataaaaataaaatttggtcctcttatgtggtgacacgtggtttgaaacccaccaaataatcgatcacaaaaaacctaagttaaggatcggtaataacctttctaattaattttgatttatattaaatcactctttttatttataaaccccactaaattatgcgatattgattgtctaagtacaaaaattctctcgaattcaatacacatgtttcatatatttagccctgttcatttaatattactagcgcatttttaatttaaaattttgtaaacttttttggtcaaagaacatttttttaattagagacagaaatctagactctttatttggaataatagtaataaagatatattaggcaatgagtttatgatgttatgtttatatagtttatttcattttaaattgaaaagcattatttttatcgaaatgaatctagtatacaatcaatatttatgttttttcatcagatactttcctattttttggcacctttcatcggactactgatttatttcaatgtgtatgcatgcatgagcatgagtatacacatgtcttttaaaatgcatgtaaagcgtaacggaccacaaaagaggatccatacaaatacatctcatcgcttcctctactattctccgacacacacactgagcatggtgcttaaacactctggtgagttctagtacttctgctatgatcgatctcattaccatttcttaaatttctctccctaaatattccgagttcttgatttttgataacttcaggttttctctttttgataaatctggtctttccatttttttttttttgtggttaatttagtttcctatgttcttcgattgtattatgcatgatctgtgtttggattctgttagattatgtattggtgaatatgtatgtgtttttgcatgtctggttttggtcttaaaaatgttcaaatctgatgatttgattgaagcttttttagtgttggtttgattcttctcaaaactactgttaatttactatcatgttttccaactttgattcatgatgacacttttgttctgctttgttataaaattttggttggtttgattttgtaattatagtgtaattttgttaggaatgaacatgttttaatactctgttttcgatttgtcacacattcgaattattaatcgataatttaactgaaaattcatggttctagatcttgttgtcatcagattatttgtttcgataattcatcaaatatgtagtccttttgctgatttgcgactgtttcattttttctcaaaattgttttttgttaagtttatctaacagttatcgttgtcaaaagtctctttcattttgcaaaatcttctttttttttttgtttgtaactttgttttttaagctacacatttagtctgtaaaatagcatcgaggaacagttgtcttagtagacttgcatgttcttgtaacttctatttgtttcagtttgttgatgactgctttgattttgtaggtcaaaccgcgccatgtctgctagcggagctttgttgcctgctatagctttcgctgcttacgcttacgctacctacgcttatgctttcgagtggagccacgctaacggaatcgataacgtggatgctagagagtggattggagctttgtctttgagactccctgcaattgcaaccacaatgtacctcttgttctgccttgtgggacctagattgatggctaagagggaggcttttgatcctaagggatttatgctcgcttacaacgcttaccaaaccgctttcaacgttgtggtgctcggaatgttcgctagagagatctctggattgggacaacctgtttggggatctactatgccttggagcgataggaagtccttcaagattttgttgggagtgtggctccactacaacaataagtacctcgagttgttggatactgtgttcatggtggctaggaaaaagaccaagcagctctctttcttgcacgtgtaccaccacgctttgttgatttgggcttggtggcttgtttgtcacctcatggctaccaacgattgcatcgatgcttatttcggagctgcttgcaactctttcatccacatcgtgatgtactcctactacctcatgtctgctttgggaattaggtgcccttggaagagatatatcacccaggctcagatgttgcaattcgtgatcgtgttcgctcacgctgttttcgtgctcagacaaaagcactgccctgttactttgccttgggcacaaatgttcgtgatgacaaatatgttggtgctcttcggaaacttctacctcaaggcttactctaacaagtctaggggagatggagcttcttctgttaagcctgctgagactactagagcaccttctgtgagaagaaccaggtcaaggaagatcgattgatagttaattaactaagtttgatgtatctgagtgccaacgtttactttgtctttcctttcttttattggttatgattagatgtttactatgttctctctttttcgttataaataaagaagttcaattcttctatagtttcaaacgcgattttaagcgtttctatttaggtttacatgatttcttttacaaaatcatctttaaaatacagtatatttttagttttcataaaatatttaaagaaatgaaagtttataaacattcactcctattctctaattaaggatttgtaaaacaaaaattttgtaagcatatcgatttatgcgttttgtcttaattagctcactaaataataaataatagcttatgttgtgggactgtttaattacctaacttagaactaaaatcaactctttgtgggcgcctactaccggtaattcccgggattagcggccgctagtctgtgcgcacttgtatcctgcaggtcaatcgtttaaacactgtacggaccgtggcctaataggccggtaccacccagctttcttgtacaaagtggccatgattacgccaagcttggccactaaggccaatttaaatctactaggccggcctactatagaaaatgtgttatatcgacatgaccagacaaaggggcaacagttaacaaaacaattaattctttcatttgagattaaggaaggtaaggtactaaaaagattaaaaaaaatgagcttatctctttgtttctgtaataataatataagtgtgataaacttttaatataataattgtaattaggttttctacagatgagcaccactcagagacaagataagaagaaaacaattttgttaaacatgattatagaaacttttagttaagtcttgaagtatcaatataacaaaaaaaagtacacacgactatgacaataaacccactaccgtcaggttatcatttcgatgaaatgttttgatatcattaaatataacagtcacaaaaaatcatctaattataacaatataacttatacatatatttaactaaaaacttagagtttttgtaatgattctaattgatgattagagtttatagaaatacaattaaataaaaaatataattttaaaaaaacatagtaaagtcaatgagatcctctctgacctcagtgatcatttagtcatgtatgtacaacaatcattgttcatcacatgactgtaaaataaataaggataaacttgggaatatatataatatattgtattaaataaaaaagggaaatacaaatatcaattttagattcccgagttgacacaactcaccatgcacgctgccacctcagctcccagctctcgtcacatgtctcatgtcagttaggtctttggtttttagtctttgacacaactcgccatgcatgttgccacgtgagctcgttcctcttcccatgatctcaccactgggcatgcatgctgccacctcagctggcacctcttctctatatgtccctagaggccatgcacagtgccacctcagcactcctctcagaacccatacgtacctgccaatcggcttctctccataaatatctatttaaattataactaattatttcatatacttaattgatgacgtggatgcattgccatcgttgtttaataattgttaattacgacatgataaataaaatgaaagtaaaaagtacgaaagattttccatttgttgttgtataaatagagaagtgagtgatgcataatgcatgaatgcatgaccgcgccaccatgactgttggatacgatgaggagatcccattcgagcaagttagggctcataacaagccagatgatgcttggtgtgctattcatggacacgtgtacgatgttaccaagttcgcttctgttcatccaggaggagatattatcttgctcgctgctggaaaggaagctactgtgctctacgagacctaccatgttagaggagtgtctgatgctgtgctcagaaagtacagaatcggaaagttgccagatggacaaggaggagctaacgagaaggagaagagaaccttgtctggattgtcctctgcttcttactacacctggaactccgatttctacagagtgatgagggagagagttgtggctagattgaaggagagaggaaaggctagaagaggaggatacgagttgtggatcaaggctttcttgctccttgttggattctggtcctctctttactggatgtgcaccctcgatccatctttcggagctatcttggctgctatgtctttgggagtgttcgctgcttttgttggaacctgcatccaacatgatggaaaccatggagcgttcgctcaatctagatgggttaacaaggtggcaggatggactttggatatgatcggagcttctggaatgacttgggagttccaacatgtgttgggacatcacccatacactaacttgatcgaggaggagaacggattgcaaaaggtgtccggaaagaagatggataccaagttggctgatcaagagtctgatccagatgtgttctccacctacccaatgatgagattgcatccatggcatcagaagagatggtatcacaggttccagcatatctacggaccattcatcttcggattcatgaccatcaacaaggtggtgactcaagatgttggagtggtgttgagaaagaggctcttccaaatcgatgctgagtgcagatatgcttccccaatgtacgttgctaggttctggatcatgaaggctttgaccgtgttgtacatggttgctctcccatgttatatgcaaggaccatggcatggattgaagctcttcgctatcgctcatttcacttgcggagaggttttggctaccatgttcatcgtgaaccacattatcgagggagtgtcttacgcttctaaggatgctgttaagggaactatggctccaccaaagactatgcatggagtgaccccaatgaacaacactagaaaggaggttgaggctgaggcttctaagtctggagctgtggttaagtctgtgccattggatgattgggctgctgttcaatgccaaacctctgtgaactggtctgttggatcttggttctggaaccatttctctggaggactcaaccatcaaatcgagcatcatctcttcccaggattgtctcacgagacctactaccacatccaagatgtggttcaatctacctgtgctgagtacggagttccataccaacatgagccatctttgtggactgcttactggaagatgctcgaacatttgagacaattgggaaacgaggagactcacgagtcttggcaaagagctgcttgattaattaactaagactcccaaaaccaccttccctgtgacagttaaaccctgcttatacctttcctcctaataatgttcatctgtcacacaaactaaaataaataaaatgggagcaataaataaaatgggagctcatatatttacaccatttacactgtctattattcaccatgccaattattacttcataattttaaaattatgtcatttttaaaaattgcttaatgatggaaaggattattataagttaaaagtataacatagataaactaaccacaaaacaaatcaatataaactaacttactctcccatctaatttttatttaaatttctttacacttctcttccatttctatttctacaacattatttaacatttttattgtatttttcttactttctaactctattcatttcaaaaatcaatatatgtttatcaccacctctctaaaaaaaactttacaatcattggtccagaaaagttaaatcacgagatggtcattttagcattaaaacaacgattcttgtatcactatttttcagcatgtagtccattctcttcaaacaaagacagcggctatataatcgttgtgttatattcagtctaaaacaaggcgcctactaccggtaattcccgggattagcggccgctagtctgtgcgcacttgtatcctgcaggttaggccggccattagcagatatttggtgtctaaatgtttattttgtgatatgttcatgtttgaaatggtggtttcgaaaccagggacaacgttgggatctgatagggtgtcaaagagtattatggattgggacaatttcggtcatgagttgcaaattcaagtatatcgttcgattatgaaaattttcgaagaatatcccatttgagagagtctttacctcattaatgtttttagattatgaaattttatcatagttcatcgtagtctttttggtgtaaaggctgtaaaaagaaattgttcacttttgttttcgtttatgtgaaggctgtaaaagattgtaaaagactattttggtgttttggataaaatgatagtttttatagattcttttgcttttagaagaaatacatttgaaattttttccatgttgagtataaaataccgaaatcgattgaagatcatagaaatattttaactgaaaacaaatttataactgattcaattctctccatttttatacctatttaaccgtaatcgattctaatagatgatcgattttttatataatcctaattaaccaacggcatgtattggataattaaccgatcaactctcacccctaatagaatcagtattttccttcgacgttaattgatcctacactatgtaggtcatatccatcgttttaatttttggccaccattcaattctgtcttgcctttagggatgtgaatatgaacggccaaggtaagagaataaaaataatccaaattaaagcaagagaggccaagtaagataatccaaatgtacacttgtcattgccaaaattagtaaaatactcggcatattgtattcccacacattattaaaataccgtatatgtattggctgcatttgcatgaataatactacgtgtaagcccaaaagaacccacgtgtagcccatgcaaagttaacactcacgaccccattcctcagtctccactatataaacccaccatccccaatctcaccaaacccaccacacaactcacaactcactctcacaccttaaagaaccaatcaccaccaaaaaaccgcgccaccatgcttgttcttttcggaaacttctacgtgaagcagtactctcaaaagaacggaaagcctgagaacggtgctactcctgaaaacggtgcaaagcctcaaccttgtgagaacggaactgttgagaagagggagaacgataccgctaatgttagacctactagaccagctggacctcctcctgctacttactacgattctctcgctgtttctggacagggaaaagagagacttttcaccaccgacgaagttagaaggcacatcctccctactgacggatggcttacttgtcacgagggagtttacgacgttactgacttccttgcaaaacaccctggtggaggtgttatcactcttggactcggaagagattgcactatcctcatcgagtcttaccaccctgctggtagacctgataaggtgatggaaaagtaccgtatcggaactcttcaagaccctaagactttctacgcttggggagagtctgatttctaccctgagcttaagagaagggctcttgctagacttaaagaggctggacaagctagaagaggtggacttggagttaaggctctccttgttcttactctcttcttcgtgtcttggtatatgtgggttgcacacaagtctttcttgtgggctgctgtttggggattcgctggatcacatgtgggactttctatccagcacgacggaaaccacggtgctttctctagaaacaccctcgttaacagacttgctggatggggaatggatcttatcggagcttcttctactgtttgggagtaccagcacgttatcggacaccaccagtacactaacctcgtttctgatacccttttcagccttcctgagaacgatcctgatgtgttctcttcttaccctctcatgagaatgcaccctgatactgcttggcaacctcaccacagattccagcaccttttcgctttccctttgttcgctctcatgaccatctctaaggttctcacctctgatttcgctgtttgcctctctatgaagaagggatctatcgattgctctagcagacttgttcctcttgagggacaacttcttttctggggtgctaaacttgctaacttcctcctccaaatcgttcttccttgttaccttcacggaactgctatgggacttgctcttttctctgttgctcaccttgtttctggtgagtaccttgctatctgcttcatcatcaaccacatctctgagtcttgtgagttcatgaacacctcattccaaactgctgctagaagaactgagatgcttcaagctgctcatcaagctgctgaggctaagaaggttaagcctactcctcctcctaacgattgggctgttactcaagttcagtgctgtgttaactggcgttctggtggagttcttgctaaccacctttctggtggacttaaccaccagatcgagcaccacctcttcccttctatctctcacgctaactaccctactatcgctcctgttgtgaaagaagtgtgcgaggaatacggacttccttacaagaactacgtgaccttctgggatgctgtttgtggaatggttcagcaccttagacttatgggtgctcctcctgttcctactaacggtgacaaaaaaagttgatgattaattaataattgattgctgctttaatgagatatgcgagacgcctatgatcgcatgatatttgctttcaattctgttgtgcacgttgtaaaaaacctgagcatgtgtagctcagatccttaccgccggtttcggttcattctaatgaatatatcacccgttactatcgtatttttatgaataatattctccgttcaatttactgattgtggcaaacactgtacggaccgtggcctaataggccggtacccaactttattatacatagttgataattcactggccggatgtaccgaattcgcggccgcaagcttgtacactagtacgcgtcaattggcgatcgcagtacttaatcagtgatcagtaactaaattcagtacattaaagacgtccgcaatgtgttattaagttgtctaagcgtcaatttgtttacaccacaatatatcctgccaccagccagccaacagctccccgaccggcagctcggcacaaaatcactgatcatctaaaaaggtgatgtgtatttgagtaaaacagcttgcgtcatgcggtcgctgcgtatatgatgcgatgagtaaataaacaaatacgcaaggggaacgcatgaaggttatcgctgtacttaaccagaaaggcgggtcaggcaagacgaccatcgcaacccatctagcccgcgccctgcaactcgccggggccgatgttctgttagtcgattccgatccccagggcagtgcccgcgattgggcggccgtgcgggaagatcaaccgctaaccgttgtcggcatcgaccgcccgacgattgaccgcgacgtgaaggccatcggccggcgcgacttcgtagtgatcgacggagcgccccaggcggcggacttggctgtgtccgcgatcaaggcagccgacttcgtgctgattccggtgcagccaagcccttacgacatttgggccaccgccgacctggtggagctggttaagcagcgcattgaggtcacggatggaaggctacaagcggcctttgtcgtgtcgcgggcgatcaaaggcacgcgcatcggcggtgaggttgccgaggcgctggccgggtacgagctgcccattcttgagtcccgtatcacgcagcgcgtgagctacccaggcactgccgccgccggcacaaccgttcttgaatcagaacccgagggcgacgctgcccgcgaggtccaggcgctggccgctgaaattaaatcaaaactcatttgagttaatgaggtaaagagaaaatgagcaaaagcacaaacacgctaagtgccggccgtccgagcgcacgcagcagcaaggctgcaacgttggccagcctggcagacacgccagccatgaagcgggtcaactttcagttgccggcggaggatcacaccaagctgaagatgtacgcggtacgccaaggcaagaccattaccgagctgctatctgaatacatcgcgcagctaccagagtaaatgagcaaatgaataaatgagtagatgaattttagcggctaaaggaggcggcatggaaaatcaagaacaaccaggcaccgacgccgtggaatgccccatgtgtggaggaacgggcggttggccaggcgtaagcggctgggttgtctgccggccctgcaatggcactggaacccccaagcccgaggaatcggcgtgagcggtcgcaaaccatccggcccggtacaaatcggcgcggcgctgggtgatgacctggtggagaagttgaaggccgcgcaggccgcccagcggcaacgcatcgaggcagaagcacgccccggtgaatcgtggcaaggggccgctgatcgaatccgcaaagaatcccggcaaccgccggcagccggtgcgccgtcgattaggaagccgcccaagggcgacgagcaaccagattttttcgttccgatgctctatgacgtgggcacccgcgatagtcgcagcatcatggacgtggccgttttccgtctgtcgaagcgtgaccgacgagctggcgaggtgatccgctacgagcttccagacgggcacgtagaggtttccgcaggccccgccggcatggccagtgtgtgggattacgacctggtactgatggcggtttcccatctaaccgaatccatgaaccgataccgggaagggaagggagacaagcccggccgcgtgttccgtccacacgttgcggacgtactcaagttctgccggcgagccgatggcggaaagcagaaagacgacctggtagaaacctgcattcggttaaacaccacgcacgttgccatgcagcgtaccaagaaggccaagaacggccgcctggtgacggtatccgagggtgaagccttgattagccgctacaagatcgtaaagagcgaaaccgggcggccggagtacatcgagatcgagcttgctgattggatgtaccgcgagatcacagaaggcaagaacccggacgtgctgacggttcaccccgattactttttgatcgaccccggcatcggccgttttctctaccgcctggcacgccgcgccgcaggcaaggcagaagccagatggttgttcaagacgatctacgaacgcagtggcagcgccggagagttcaagaagttctgtttcaccgtgcgcaagctgatcgggtcaaatgacctgccggagtacgatttgaaggaggaggcggggcaggctggcccgatcctagtcatgcgctaccgcaacctgatcgagggcgaagcatccgccggttcctaatgtacggagcagatgctagggcaaattgccctagcaggggaaaaaggtcgaaaaggtctctttcctgtggatagcacgtacattgggaacccaaagccgtacattgggaaccggaacccgtacattgggaacccaaagccgtacattgggaaccggtcacacatgtaagtgactgatataaaagagaaaaaaggcgatttttccgcctaaaactctttaaaacttattaaaactcttaaaacccgcctggcctgtgcataactgtctggccagcgcacagccgaagagctgcaaaaagcgcctacccttcggtcgctgcgctccctacgccccgccgcttcgcgtcggcctatcgcggcctatgcggtgtgaaataccgcacagatgcgtaaggagaaaataccgcatcaggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtccttcaactcatcgatagtttggctgtgagcaattatgtgcttagtgcatctaacgcttgagttaagccgcgccgcgaagcggcgtcggcttgaacgaatttctagctagacattatttgccaacgaccttcgtgatctcgcccttgacatagtggacaaattcttcgagctggtcggcccgggacgcgagacggtcttcttcttggcccagataggcttggcgcgcttcgaggatcacgggctggtattgcgccggaaggcgctccatcgcccagtcggcggcgacatccttcggcgcgatcttgccggtaaccgccgagtaccaaatccggctcagcgtaaggaccacattgcgctcatcgcccgcccaatccggcggggagttccacagggtcagcgtctcgttcagtgcttcgaacagatcctgttccggcaccgggtcgaaaagttcctcggccgcggggccgacgagggccacgctatgctcccgggccttggtgagcaggatcgccagatcaatgtcgatggtggccggttcaaagatacccgccagaatatcattacgctgccattcgccgaactggagttcgcgtttggccggatagcgccaggggatgatgtcatcgtgcaccacaatcgtcacctcaaccgcgcgcaggatttcgctctcgccgggggaggcggacgtttccagaaggtcgttgataagcgcgcggcgcgtggtctcgtcgagacggacggtaacggtgacaagcaggtcgatgtccgaatggggcttaaggccgccgtcaacggcgctaccatacagatgcacggcgaggagggtcggttcgaggtggcgctcgatgacacccacgacttccgacagctgggtggacacctcggcgatgaccgcttcacccatgatgtttaactttgttttagggcgactgccctgctgcgtaacatcgttgctgctccataacatcaaacatcgacccacggcgtaacgcgcttgctgcttggatgcccgaggcatagactgtaccccaaaaaaacagtcataacaagccatgaaaaccgccactgcgttccatgaatattcaaacaaacacatacagcgcgacttatcatggata

SEQ ID NO: 11 - DNA, 15229 bp, Artificial Sequence
  plasmid
ttgacatacaaatggacgaacggataaaccttttcacgcccttttaaatatccgattattctaataaacgctcttttctcttaggtttacccgccaatatatcctgtcaaacactgatagtttaaactgaaggcgggaaacgacaatctgatcactgattagtaactaaggcctttaattaatctagaggcgcgccgggccccctgcagggagctcggccggccaatttaaattgatatcggtacatcgattacgccaagctatcaactttgtatagaaaagttgccatgattacgccaagcttggccactaaggccaatttaaatctactaggccggccaaagtaggcgcctactaccggtaattcccgggattagcggccgctagtctgtgcgcacttgtatcctgcaggtcaatcgtttaaacactgtacggaccgtggcctaataggccggtacccaagtttgtacaaaaaagcaggctccatgattacgccaagcttggccactaaggccaatttaaatctactaggccggccaaagctttacaacgctacacaaaacttataaccgtaatcaccattcattaacttaactactatcacatgcattcatgaattgaaacgagaaggatgtaaatagttgggaagttatctccacgttgaagagatcgttagcgagagctgaaagaccgagggaggagacgccgtcaacacggacagagtcgtcgaccctcacatgaagtaggaggaatctccgtgaggagccagagagacgtctttggtcttcggtttcgatccttgatctgacggagaagacgagagaagtgcgactggactccgtgaggaccaacagagtcgtcctcggtttcgatcgtcggtattggtggagaaggcggaggaatctccgtgacgagccagagagatgtcgtcggtcttcggtttcgatccttgatctgacggagaagacgagagaagtgcgacgagactccgtgaggaccaacagagttgtcctcggtttcgatcgtcggtttcggcggagaaggcggaggaatctccgtgaggagccagagagacgtcgttggtcttcggtttcgatccttgatctgttggagaagacgagacaagtgggacgagactcaacgacggagtcagagacgtcgtcggtcttcggtttcggccgagaaggcggagtcggtcttcggtttcggccgagaaggcggaggagacgtcttcgatttgggtctctcctcttgacgaagaaaacaaagaacacgagaaataatgagaaagagaacaaaagaaaaaaaaataaaaataaaaataaaatttggtcctcttatgtggtgacacgtggtttgaaacccaccaaataatcgatcacaaaaaacctaagttaaggatcggtaataacctttctaattaattttgatttatattaaatcactctttttatttataaaccccactaaattatgcgatattgattgtctaagtacaaaaattctctcgaattcaatacacatgtttcatatatttagccctgttcatttaatattactagcgcatttttaatttaaaattttgtaaacttttttggtcaaagaacatttttttaattagagacagaaatctagactctttatttggaataatagtaataaagatatattaggcaatgagtttatgatgttatgtttatatagtttatttcattttaaattgaaaagcattatttttatcgaaatgaatctagtatacaatcaatatttatgttttttcatcagatactttcctattttttggcacctttcatcggactactgatttatttcaatgtgtatgcatgcatgagcatgagtatacacatgtcttttaaaatgcatgtaaagcgtaacggaccacaaaagaggatccatacaaatacatctcatcgcttcctctactattctccgacacacacactgagcatggtgcttaaacactctggtgagttctagtacttctgctatgatcgatctcattaccatttcttaaatttctctccctaaatattccgagttcttgatttttgataacttcaggttttctctttttgataaatctggtctttccatttttttttttttgtggttaatttagtttcctatgttcttcgattgtattatgcatgatctgtgtttggattctgttagattatgtattggtgaatatgtatgtgtttttgcatgtctggttttggtcttaaaaatgttcaaatctgatgatttgattgaagcttttttagtgttggtttgattcttctcaaaactactgttaatttactatcatgttttccaactttgattcatgatgacacttttgttctgctttgttataaaattttggttggtttgattttgtaattatagtgtaattttgttaggaatgaacatgttttaatactctgttttcgatttgtcacacattcgaattattaatcgataatttaactgaaaattcatggttctagatcttgttgtcatcagattatttgtttcgataattcatcaaatatgtagtccttttgctgatttgcgactgtttcattttttctcaaaattgttttttgttaagtttatctaacagttatcgttgtcaaaagtctctttcattttgcaaaatcttctttttttttttgtttgtaactttgttttttaagctacacatttagtctgtaaaatagcatcgaggaacagttgtcttagtagacttgcatgttcttgtaacttctatttgtttcagtttgttgatgactgctttgattttgtaggtcaaaccgcgccatgtctgctagcggagctttgttgcctgctatagctttcgctgcttacgcttacgctacctacgcttatgctttcgagtggagccacgctaacggaatcgataacgtggatgctagagagtggattggagctttgtctttgagactccctgcaattgcaaccacaatgtacctcttgttctgccttgtgggacctagattgatggctaagagggaggcttttgatcctaagggatttatgctcgcttacaacgcttaccaaaccgctttcaacgttgtggtgctcggaatgttcgctagagagatctctggattgggacaacctgtttggggatctactatgccttggagcgataggaagtccttcaagattttgttgggagtgtggctccactacaacaataagtacctcgagttgttggatactgtgttcatggtggctaggaaaaagaccaagcagctctctttcttgcacgtgtaccaccacgctttgttgatttgggcttggtggcttgtttgtcacctcatggctaccaacgattgcatcgatgcttatttcggagctgcttgcaactctttcatccacatcgtgatgtactcctactacctcatgtctgctttgggaattaggtgcccttggaagagatatatcacccaggctcagatgttgcaattcgtgatcgtgttcgctcacgctgttttcgtgctcagacaaaagcactgccctgttactttgccttgggcacaaatgttcgtgatgacaaatatgttggtgctcttcggaaacttctacctcaaggcttactctaacaagtctaggggagatggagcttcttctgttaagcctgctgagactactagagcaccttctgtgagaagaaccaggtcaaggaagatcgattgatagttaattaactaagtttgatgtatctgagtgccaacgtttactttgtctttcctttcttttattggttatgattagatgtttactatgttctctctttttcgttataaataaagaagttcaattcttctatagtttcaaacgcgattttaagcgtttctatttaggtttacatgatttcttttacaaaatcatctttaaaatacagtatatttttagttttcataaaatatttaaagaaatgaaagtttataaacattcactcctattctctaattaaggatttgtaaaacaaaaattttgtaagcatatcgatttatgcgttttgtcttaattagctcactaaataataaataatagcttatgttgtgggactgtttaattacctaacttagaactaaaatcaactctttgtgggcgcctactaccggtaattcccgggattagcggccgctagtctgtgcgcacttgtatcctgcaggtcaatcgtttaaacactgtacggaccgtggcctaataggccggtaccacccagctttcttgtacaaagtggccatgattacgccaagcttggccactaaggccaatttaaatctactaggccggcctactatagaaaatgtgttatatcgacatgaccagacaaaggggcaacagttaacaaaacaattaattctttcatttgagattaaggaaggtaaggtactaaaaagattaaaaaaaatgagcttatctctttgtttctgtaataataatataagtgtgataaacttttaatataataattgtaattaggttttctacagatgagcaccactcagagacaagataagaagaaaacaattttgttaaacatgattatagaaacttttagttaagtcttgaagtatcaatataacaaaaaaaagtacacacgactatgacaataaacccactaccgtcaggttatcatttcgatgaaatgttttgatatcattaaatataacagtcacaaaaaatcatctaattataacaatataacttatacatatatttaactaaaaacttagagtttttgtaatgattctaattgatgattagagtttatagaaatacaattaaataaaaaatataattttaaaaaaacatagtaaagtcaatgagatcctctctgacctcagtgatcatttagtcatgtatgtacaacaatcattgttcatcacatgactgtaaaataaataaggataaacttgggaatatatataatatattgtattaaataaaaaagggaaatacaaatatcaattttagattcccgagttgacacaactcaccatgcacgctgccacctcagctcccagctctcgtcacatgtctcatgtcagttaggtctttggtttttagtctttgacacaactcgccatgcatgttgccacgtgagctcgttcctcttcccatgatctcaccactgggcatgcatgctgccacctcagctggcacctcttctctatatgtccctagaggccatgcacagtgccacctcagcactcctctcagaacccatacgtacctgccaatcggcttctctccataaatatctatttaaattataactaattatttcatatacttaattgatgacgtggatgcattgccatcgttgtttaataattgttaattacgacatgataaataaaatgaaagtaaaaagtacgaaagattttccatttgttgttgtataaatagagaagtgagtgatgcataatgcatgaatgcatgaccgcgccaccatgactgttggatacgatgaggagatcccattcgagcaagttagggctcataacaagccagatgatgcttggtgtgctattcatggacacgtgtacgatgttaccaagttcgcttctgttcatccaggaggagatattatcttgctcgctgctggaaaggaagctactgtgctctacgagacctaccatgttagaggagtgtctgatgctgtgctcagaaagtacagaatcggaaagttgccagatggacaaggaggagctaacgagaaggagaagagaaccttgtctggattgtcctctgcttcttactacacctggaactccgatttctacagagtgatgagggagagagttgtggctagattgaaggagagaggaaaggctagaagaggaggatacgagttgtggatcaaggctttcttgctccttgttggattctggtcctctctttactggatgtgcaccctcgatccatctttcggagctatcttggctgctatgtctttgggagtgttcgctgcttttgttggaacctgcatccaacatgatggaaaccatggagctttcgctcaatctagatgggttaacaaggtggcaggatggactttggatatgatcggagcttctggaatgacttgggagttccaacatgtgttgggacatcacccatacactaacttgatcgaggaggagaacggattgcaaaaggtgtccggaaagaagatggataccaagttggctgatcaagagtctgatccagatgtgttctccacctacccaatgatgagattgcatccatggcatcagaagagatggtatcacaggttccagcatatctacggaccattcatcttcggattcatgaccatcaacaaggtggtgactcaagatgttggagtggtgttgagaaagaggctcttccaaatcgatgctgagtgcagatatgcttccccaatgtacgttgctaggttctggatcatgaaggctttgaccgtgttgtacatggttgctctcccatgttatatgcaaggaccatggcatggattgaagctcttcgctatcgctcatttcacttgcggagaggttttggctaccatgttcatcgtgaaccacattatcgagggagtgtcttacgcttctaaggatgctgttaagggaactatggctccaccaaagactatgcatggagtgaccccaatgaacaacactagaaaggaggttgaggctgaggcttctaagtctggagctgtggttaagtctgtgccattggatgattgggctgctgttcaatgccaaacctctgtgaactggtctgttggatcttggttctggaaccatttctctggaggactcaaccatcaaatcgagcatcatctcttcccaggattgtctcacgagacctactaccacatccaagatgtggttcaatctacctgtgctgagtacggagttccataccaacatgagccatctttgtggactgcttactggaagatgctcgaacatttgagacaattgggaaacgaggagactcacgagtcttggcaaagagctgcttgattaattaactaagactcccaaaaccaccttccctgtgacagttaaaccctgcttatacctttcctcctaataatgttcatctgtcacacaaactaaaataaataaaatgggagcaataaataaaatgggagctcatatatttacaccatttacactgtctattattcaccatgccaattattacttcataattttaaaattatgtcatttttaaaaattgcttaatgatggaaaggattattataagttaaaagtataacatagataaactaaccacaaaacaaatcaatataaactaacttactctcccatctaatttttatttaaatttctttacacttctcttccatttctatttctacaacattatttaacatttttattgtatttttcttactttctaactctattcatttcaaaaatcaatatatgtttatcaccacctctctaaaaaaaactttacaatcattggtccagaaaagttaaatcacgagatggtcattttagcattaaaacaacgattcttgtatcactatttttcagcatgtagtccattctcttcaaacaaagacagcggctatataatcgttgtgttatattcagtctaaaacaaggcgcctactaccggtaattcccgggattagcggccgctagtctgtgcgcacttgtatcctgcaggttaggccggccattagcagatatttggtgtctaaatgtttattttgtgatatgttcatgtttgaaatggtggtttcgaaaccagggacaacgttgggatctgatagggtgtcaaagagtattatggattgggacaatttcggtcatgagttgcaaattcaagtatatcgttcgattatgaaaattttcgaagaatatcccatttgagagagtctttacctcattaatgtttttagattatgaaattttatcatagttcatcgtagtctttttggtgtaaaggctgtaaaaagaaattgttcacttttgttttcgtttatgtgaaggctgtaaaagattgtaaaagactattttggtgttttggataaaatgatagtttttatagattcttttgcttttagaagaaatacatttgaaattttttccatgttgagtataaaataccgaaatcgattgaagatcatagaaatattttaactgaaaacaaatttataactgattcaattctctccatttttatacctatttaaccgtaatcgattctaatagatgatcgattttttatataatcctaattaaccaacggcatgtattggataattaaccgatcaactctcacccctaatagaatcagtattttccttcgacgttaattgatcctacactatgtaggtcatatccatcgttttaatttttggccaccattcaattctgtcttgcctttagggatgtgaatatgaacggccaaggtaagagaataaaaataatccaaattaaagcaagagaggccaagtaagataatccaaatgtacacttgtcattgccaaaattagtaaaatactcggcatattgtattcccacacattattaaaataccgtatatgtattggctgcatttgcatgaataatactacgtgtaagcccaaaagaacccacgtgtagcccatgcaaagttaacactcacgaccccattcctcagtctccactatataaacccaccatccccaatctcaccaaacccaccacacaactcacaactcactctcacaccttaaagaaccaatcaccaccaaaaaaccgcgccaccatgccacctagtgctgctagtgaaggtggtgttgctgaacttagagctgctgaagttgctagctacactagaaaggctgttgacgaaagacctgacctcactatagttggtgacgctgtttacgacgctaaggcttttagggacgagcaccctggtggtgctcacttcgttagccttttcggaggtagggacgctactgaggcttttatggaatatcaccgtagagcttggcctaaggctaggatgtctaagttcttcgttggttcacttgacgctagcgagaagcctactcaagctgattcagcttaccttagactttgcgctgaggttaacgctcttttgcctaagggtagcggaggattcgctcctcctagctactggcttaaggctgctgctcttgttgttgctgctgttagtatagagggttatatgctccttaggggtaagacccttttgcttagcgttttccttggactcgtgttcgcttggataggacttaatattcagcacgacgctaatcacggtgctcttagtagacactcagtgattaactactgcctcggttacgctcaggattggataggtggtaatatggtgctttggcttcaagagcacgttgtgatgcaccacctccacactaacgacgttgacgctgatcctgatcaaaaggctcacggtgttcttagacttaagcctactgacggttggatgccttggcacgcacttcaacaactctatatccttcctggtgaggctatgtacgcttttaagcttcttttcttggacgcccttgagcttcttgcttggaggtgggagggtgagaagattagccctcttgctagagctttgttcgctcctgctgttgcttgtaagcttggattctgggctagattcgttgctctccctctctggcttcaacctactgttcacactgctttgtgtatctgtgctactgtgtgtactggtagcttctacctcgccttcttcttctttatctctcacaacttcgacggtgttggtagcgttggacctaagggatcacttcctagatcagctactttcgttcaacgtcaggttgagactagctctaacgttggtggttactggcttggagttcttaacggtggacttaactttcagatagagcaccacttgttccctaggcttcaccactcttactacgctcaaatagctcctgtggttaggactcacatagagaagctcggttttaagtaccgtcacttccctaccgttggatctaaccttagctcaatgcttcagcatatgggtaagatgggaactagacctggtgctgagaagggtggtaaggctgagtagtgattaattaataattgattgctgctttaatgagatatgcgagacgcctatgatcgcatgatatttgctttcaattctgttgtgcacgttgtaaaaaacctgagcatgtgtagctcagatccttaccgccggtttcggttcattctaatgaatatatcacccgttactatcgtatttttatgaataatattctccgttcaatttactgattgtggcaaacactgtacggaccgtggcctaataggccggtacccaactttattatacatagttgataattcactggccggatgtaccgaattcgcggccgcaagcttgtacactagtacgcgtcaattggcgatcgcagtacttaatcagtgatcagtaactaaattcagtacattaaagacgtccgcaatgtgttattaagttgtctaagcgtcaatttgtttacaccacaatatatcctgccaccagccagccaacagctccccgaccggcagctcggcacaaaatcactgatcatctaaaaaggtgatgtgtatttgagtaaaacagcttgcgtcatgcggtcgctgcgtatatgatgcgatgagtaaataaacaaatacgcaaggggaacgcatgaaggttatcgctgtacttaaccagaaaggcgggtcaggcaagacgaccatcgcaacccatctagcccgcgccctgcaactcgccggggccgatgttctgttagtcgattccgatccccagggcagtgcccgcgattgggcggccgtgcgggaagatcaaccgctaaccgttgtcggcatcgaccgcccgacgattgaccgcgacgtgaaggccatcggccggcgcgacttcgtagtgatcgacggagcgccccaggcggcggacttggctgtgtccgcgatcaaggcagccgacttcgtgctgattccggtgcagccaagcccttacgacatttgggccaccgccgacctggtggagctggttaagcagcgcattgaggtcacggatggaaggctacaagcggcctttgtcgtgtcgcgggcgatcaaaggcacgcgcatcggcggtgaggttgccgaggcgctggccgggtacgagctgcccattcttgagtcccgtatcacgcagcgcgtgagctacccaggcactgccgccgccggcacaaccgttcttgaatcagaacccgagggcgacgctgcccgcgaggtccaggcgctggccgctgaaattaaatcaaaactcatttgagttaatgaggtaaagagaaaatgagcaaaagcacaaacacgctaagtgccggccgtccgagcgcacgcagcagcaaggctgcaacgttggccagcctggcagacacgccagccatgaagcgggtcaactttcagttgccggcggaggatcacaccaagctgaagatgtacgcggtacgccaaggcaagaccattaccgagctgctatctgaatacatcgcgcagctaccagagtaaatgagcaaatgaataaatgagtagatgaattttagcggctaaaggaggcggcatggaaaatcaagaacaaccaggcaccgacgccgtggaatgccccatgtgtggaggaacgggcggttggccaggcgtaagcggctgggttgtctgccggccctgcaatggcactggaacccccaagcccgaggaatcggcgtgagcggtcgcaaaccatccggcccggtacaaatcggcgcggcgctgggtgatgacctggtggagaagttgaaggccgcgcaggccgcccagcggcaacgcatcgaggcagaagcacgccccggtgaatcgtggcaaggggccgctgatcgaatccgcaaagaatcccggcaaccgccggcagccggtgcgccgtcgattaggaagccgcccaagggcgacgagcaaccagattttttcgttccgatgctctatgacgtgggcacccgcgatagtcgcagcatcatggacgtggccgttttccgtctgtcgaagcgtgaccgacgagctggcgaggtgatccgctacgagcttccagacgggcacgtagaggtttccgcaggccccgccggcatggccagtgtgtgggattacgacctggtactgatggcggtttcccatctaaccgaatccatgaaccgataccgggaagggaagggagacaagcccggccgcgtgttccgtccacacgttgcggacgtactcaagttctgccggcgagccgatggcggaaagcagaaagacgacctggtagaaacctgcattcggttaaacaccacgcacgttgccatgcagcgtaccaagaaggccaagaacggccgcctggtgacggtatccgagggtgaagccttgattagccgctacaagatcgtaaagagcgaaaccgggcggccggagtacatcgagatcgagcttgctgattggatgtaccgcgagatcacagaaggcaagaacccggacgtgctgacggttcaccccgattactttttgatcgaccccggcatcggccgttttctctaccgcctggcacgccgcgccgcaggcaaggcagaagccagatggttgttcaagacgatctacgaacgcagtggcagcgccggagagttcaagaagttctgtttcaccgtgcgcaagctgatcgggtcaaatgacctgccggagtacgatttgaaggaggaggcggggcaggctggcccgatcctagtcatgcgctaccgcaacctgatcgagggcgaagcatccgccggttcctaatgtacggagcagatgctagggcaaattgccctagcaggggaaaaaggtcgaaaaggtctctttcctgtggatagcacgtacattgggaacccaaagccgtacattgggaaccggaacccgtacattgggaacccaaagccgtacattgggaaccggtcacacatgtaagtgactgatataaaagagaaaaaaggcgatttttccgcctaaaactctttaaaacttattaaaactcttaaaacccgcctggcctgtgcataactgtctggccagcgcacagccgaagagctgcaaaaagcgcctacccttcggtcgctgcgctccctacgccccgccgcttcgcgtcggcctatcgcggcctatgcggtgtgaaataccgcacagatgcgtaaggagaaaataccgcatcaggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtccttcaactcatcgatagtttggctgtgagcaattatgtgcttagtgcatctaacgcttgagttaagccgcgccgcgaagcggcgtcggcttgaacgaatttctagctagacattatttgccaacgaccttcgtgatctcgcccttgacatagtggacaaattcttcgagctggtcggcccgggacgcgagacggtcttcttcttggcccagataggcttggcgcgcttcgaggatcacgggctggtattgcgccggaaggcgctccatcgcccagtcggcggcgacatccttcggcgcgatcttgccggtaaccgccgagtaccaaatccggctcagcgtaaggaccacattgcgctcatcgcccgcccaatccggcggggagttccacagggtcagcgtctcgttcagtgcttcgaacagatcctgttccggcaccgggtcgaaaagttcctcggccgcggggccgacgagggccacgctatgctcccgggccttggtgagcaggatcgccagatcaatgtcgatggtggccggttcaaagatacccgccagaatatcattacgctgccattcgccgaactggagttcgcgtttggccggatagcgccaggggatgatgtcatcgtgcaccacaatcgtcacctcaaccgcgcgcaggatttcgctctcgccgggggaggcggacgtttccagaaggtcgttgataagcgcgcggcgcgtggtctcgtcgagacggacggtaacggtgacaagcaggtcgatgtccgaatggggcttaaggccgccgtcaacggcgctaccatacagatgcacggcgaggagggtcggttcgaggtggcgctcgatgacacccacgacttccgacagctgggtggacacctcggcgatgaccgcttcacccatgatgtttaactttgttttagggcgactgccctgctgcgtaacatcgttgctgctccataacatcaaacatcgacccacggcgtaacgcgcttgctgcttggatgcccgaggcatagactgtaccccaaaaaaacagtcataacaagccatgaaaaccgccactgcgttccatgaatattcaaacaaacacatacagcgcgacttatcatggata

SEQ ID NO: 12 - DNA, 27 bp, Artificial Sequence
  probe oligo
cgctcacttcttcgttgctggactctc

SEQ ID NO: 13 - DNA, 19 bp, Artificial Sequence
  probe oligo
atcatctctctcggagttc

SEQ ID NO: 14 - DNA, 29 bp, Artificial Sequence
  probe oligo
cgctgctcctatcatcccaactttcttca

SEQ ID NO: 15 - DNA, 22 bp, Artificial Sequence
  probe oligo
tcgacctagaggatccccggcc

SEQ ID NO: 16 - DNA, 24 bp, Artificial Sequence
  probe oligo
ctctgccagcgaccaaatcgaagc

SEQ ID NO: 17 - DNA, 18 bp, Artificial Sequence
  probe oligo
ccttgtgttagtttaatg

SEQ ID NO: 18 - DNA, 24 bp, Artificial Sequence
  probe oligo
tgacaaacaagccaccaagcccaa

SEQ ID NO: 19 - DNA, 29 bp, Artificial Sequence
  probe oligo
tgcttccccaatgtacgttgctaggttct

SEQ ID NO: 20 - DNA, 14 bp, Artificial Sequence
  probe oligo
aaggcacatcctcc

SEQ ID NO: 21 - DNA, 27 bp, Artificial Sequence
  probe oligo
agcttcttttcttggacgcccttgagc

SEQ ID NO: 22 - DNA, 25 bp, Artificial Sequence
  probe oligo
ggattcgacattccatcggctttga

SEQ ID NO: 23 - DNA, 21 bp, Artificial Sequence
  forward primer
ccgctgtggttatctctttgc

SEQ ID NO: 24 - DNA, 26 bp, Artificial Sequence
  forward primer
cttgggaggctatgtatgttagaaga

SEQ ID NO: 25 - DNA, 22 bp, Artificial Sequence
  forward primer
gctttccctgagcttgttagga

SEQ ID NO: 26 - DNA, 20 bp, Artificial Sequence
  forward primer
ggaggctaaggctgctgcta

SEQ ID NO: 27 - DNA, 21 bp, Artificial Sequence
  forward primer
gaccccctctctctcgttgtc

SEQ ID NO: 28 - DNA, 20 bp, Artificial Sequence
  forward primer
gcaatcgttggtagccatga

SEQ ID NO: 29 - DNA, 22 bp, Artificial Sequence
  forward primer
caaatcgatgctgagtgcagat

SEQ ID NO: 30 - DNA, 23 bp, Artificial Sequence
  forward primer
tgacaagtaagccatccgtcagt

SEQ ID NO: 31 - DNA, 23 bp, Artificial Sequence
  forward primer
ctggtgaggctatgtacgctttt

SEQ ID NO: 32 - DNA, 25 bp, Artificial Sequence
  forward primer
gatgaatatcctcctgatgctaacc

SEQ ID NO: 33 - DNA, 24 bp, Artificial Sequence
  reverse primer
tcttaagtcccaactggagagaca

SEQ ID NO: 34 - DNA, 24 bp, Artificial Sequence
  reverse primer
aaaccaaggagcgtcaagtctaga

SEQ ID NO: 35 - DNA, 26 bp, Artificial Sequence
  reverse primer
tcaacaactccgtacttagcgtacat

SEQ ID NO: 36 - DNA, 28 bp, Artificial Sequence
  reverse primer
tgcatgtacgttatatagtaggcttttg

SEQ ID NO: 37 - DNA, 23 bp, Artificial Sequence
  reverse primer
gcagatgtagaagccatggtttg

SEQ ID NO: 38 - DNA, 20 bp, Artificial Sequence
  reverse primer
cgtgtaccaccacgctttgt

SEQ ID NO: 39 - DNA, 24 bp, Artificial Sequence
  reverse primer
aacacggtcaaagccttcataatc

SEQ ID NO: 40 - DNA, 22 bp, Artificial Sequence
  reverse primer
acttttcaccaccgacgaagtt

SEQ ID NO: 41 - DNA, 18 bp, Artificial Sequence
  reverse primer
cctcccacctccaagcaa

SEQ ID NO: 42 - DNA, 22 bp, Artificial Sequence
  reverse primer
cttgcatgatgatcaggaaagc

SEQ ID NO: 43 - DNA, 114 bp, Artificial Sequence
  spacer sequence
ttaattcagctagctagcctcagctgacgttacgtaacgctaggtagcgtcacgtgacgttagctaacgctaggtagcgtcagctgagcttacgtaagcgcttagcagatattt

SEQ ID NO: 44 - DNA, 157 bp, Artificial Sequence
  spacer sequence
ttactgattgtctacgtaggctcagctgagcttacctaaggctacgtaggctcacgtgacgttacgtaaggctacgtagcgtcacgtgagcttacctaactctagctagcctcacgtgaccttagctaacactaggtagcgtcagctcgacggcccg

SEQ ID NO: 45 - DNA, 106 bp, Artificial Sequence
  spacer sequence
ggcggagtggggctacgtagcgtcacgtgacgttacctaagcctaggtagcctcagctgacgttacgtaacgctaggtaggctcagctgacacgggcaggacatag

SEQ ID NO: 46 - DNA, 204 bp, Artificial Sequence
  spacer sequence
gaatgaaaccgatctacgtaggctcagctgagcttagctaagcctacctagcctcacgtgagattatgtaaggctaggtagcgtcacgtgacgttacctaacactagctagcgtcagctgagcttagctaaccctacgtagcctcacgtgagcttacctaacgctacgtagcctcacgtgactaaggatgacctacccattctt

SEQ ID NO: 47 - DNA, 127 bp, Artificial Sequence
  spacer sequence
gcggccgctagctagcctcagctgacgttacgtaacgctaggtagcgtcacgtgacgttagctaacgctaggtagcgtcagctgagcttacgtaagcgccacgggcaggacatagggactactacaa

SEQ ID NO: 48 - DNA, 160 bp, Artificial Sequence
  spacer sequence
cgaatgaaaccgatctacgtaggctcagctgagcttacctaaggctacgtaggctcacgtgacgttacgtaaggctacgtagcgtcacgtgagcttacctaactctagctagcctcacgtgaccttagctaacactaggtagcgtcagcttagcagatat

SEQ ID NO: 49 - DNA, 235 bp, Artificial Sequence
  spacer sequence
ccgttcaatttactgattgtctacgtagcgtcacctgacgttacgtaaggctacctaggctcacgtgacgttacgtaacgctacgtagcgtcaggtgaggttagctaacgctagctagcctcacctgacgttaggtaaggctacgtagcgtcacctgagattagctaagcctacctagactcacgtgaccttaggtaacgctacgtagcgtcaaagctttacaacgctacacaaa

SEQ ID NO: 50 - DNA, 208 bp, Artificial Sequence
  spacer sequence
ttacctaacttagaactaaaatcaactctttgtgacgcgtctacctagagtcagctgagcttagctaacgctagctagtgtcagctgacgttacgtaaggctaactagcgtcacgtgaccttacgtaacgctacgtaggctcagctgagcttagctaaccctagctagtgtcacgtgagcttacgctactatagaaaatgtgttatat

SEQ ID NO: 51 - DNA, 117 bp, Artificial Sequence
  spacer sequence
ttcagtctaaaacaactacgtagcgtcacgtgacgttacctaagcctaggtagcctcagctgacgttacgtaacgctaggtaggctcagctgactgcagcaaatttacacattgcca

SEQ ID NO: 52 - DNA, 179 bp, Artificial Sequence
  spacer sequence
taattcggcgttaattcagctacgtaggctcagctgagcttacctaaggctacgtaggctcacgtgacgttacgtaaggctacgtagcgtcacgtgagcttacctaactctagctagcctcacgtgaccttagctaacactaggtagcgtcagcacagatgaatactagctgttgttca

SEQ ID NO: 53 - DNA, 147 bp, Artificial Sequence
  spacer sequence
atcatgatgcttctctgagccgtgtttgctagctagcctcagctgacgttacgtaacgctaggtagcgtcacgtgacgttagctaacgctaggtagcgtcagctgagcttacgtaagcgcacagatgaatactagctgttgttcaca

SEQ ID NO: 54 - DNA, 169 bp, Artificial Sequence
  spacer sequence
cttctctgagccgtgtttgctagctagcctcagctgacgttacgtaacgctaggtagcgtcacgtgacgttagctaacgctaggtagcgtcagctgagcttacgtaagcgcttaattaaagtactgatatcggtaccaaatcgaatccaaaaattacggatatgaatat

SEQ ID NO: 55 - DNA, 363 bp, Artificial Sequence
  spacer sequence
attacaacggtatatatcctgccagtcagcatcatcacaccaaaagttaggcccgaatagtttgaaattagaaagctcgcaattgaggtctacaggccaaattcgctcttagccgtacaatattactcaccggtgcgatgccccccatcgtaggtgaaggtggaaattaatggcgcgcctgatcactgattagtaactattacgtaagcctacgtagcgtcacgtgacgttagctaacgctacgtagcctcagctgacgttacgtaagcctacgtagcgtcacgtgagcttagctaacgctacctaggctcagctgacgttacgtaacgctagctagcgtcactcctgcagcaaatttacaca

SEQ ID NO: 56 - DNA, 780 bp, Artificial Sequence
  spacer sequence
gagatgaaaccggtgattatcagaaccttttatggtctttgtatgcatatggtaaaaaaacttagtttgcaatttcctgtttgttttggtaatttgagtttcttttagttgttgatctgcctgctttttggtttacgtcagactactactgctgttgttgtttggtttcctttctttcattttataaataaataatccggttcggtttactccttgtgactggctcagtttggttattgcgaaatgcgaatggtaaattgagtaattgaaattcgttattagggttctaagctgttttaacagtcactgggttaatatctctcgaatcttgcatggaaaatgctcttaccattggtttttaattgaaatgtgctcatatgggccgtggtttccaaattaaataaaactacgatgtcatcgagaagtaaaatcaactgtgtccacattatcagttttgtgtatacgatgaaatagggtaattcaaaatctagcttgatatgccttttggttcattttaaccttctgtaaacattttttcagattttgaacaagtaaatccaaaaaaaaaaaaaaaaatctcaactcaacactaaattattttaatgtataaaagatgcttaaaacatttggcttaaaagaaagaagctaaaaacatagagaactcttgtaaattgaagtatgaaaatatactgaattgggtattatatgaatttttctgatttaggattcacatgatccaaaaaggaaatccagaagcactaatcagacattggaagtagg

SEQ ID NO: 57 - DNA, 343 bp, Artificial Sequence
  spacer sequence
acatacaaatggacgaacggataaaccttttcacgcccttttaaatatccgattattctaataaacgctcttttctcttaggtttacccgccaatatatcctgtcaaacactgatagtttaaactgaaggcgggaaacgacaatctgatcactgattagtaactaaggcctttaattaatctagaggcgcgccgggccccctgcagggagctcggccggccaatttaaattgatatcggtacatcgattacgccaagctatcaactttgtatagaaaagttgccatgattacgccaagcttggccactaaggccaatttcgcgccctgcagcaaatttacaca

SEQ ID NO: 58 - DNA, 168 bp, Artificial Sequence
  spacer sequence
caatttactgattgtgtcgacgcgatcgcgtgcaaacactgtacggaccgtggcctaataggccggtacccaagtttgtacaaaaaagcaggctccatgattacgccaagcttggccactaaggccaatttaaatctactaggccggccatcgacggcccggactgta

SEQ ID NO: 59 - DNA, 108 bp, Artificial Sequence
  spacer sequence
ggcggagtggggggcgcctactaccggtaattcccgggattagcggccgctagtctgtgcgcacttgtatcctgcaggttaggccggccacacgggcaggacataggg

SEQ ID NO: 60 - DNA, 209 bp, Artificial Sequence
  spacer sequence
aaaccgaatgaaaccgatggcgcctaccggtatcggtccgattgcggccgcttaaagggcgaattcgtttaaacactgtacggaccgtggcctaataggccggtaccacccagctttcttgtacaaagtggccatgattacgccaagcttggccactaaggccaatttaaatctactaggccggccataaggatgacctacccattctt

SEQ ID NO: 61 - DNA, 114 bp, Artificial Sequence
  spacer sequence
ttaattcagggccggccaaagtaggcgcctactaccggtaattcccgggattagcggccgctagtctgtgcgcacttgtatcctgcaggttaggccggccattagcagatattt

SEQ ID NO: 62 - DNA, 22 bp, Artificial Sequence
  forward primer
cggagtttgtgaaccctaagga

SEQ ID NO: 63 - DNA, 23 bp, Artificial Sequence
  forward primer
tgacaagtaagccatccgtcagt

SEQ ID NO: 64 - DNA, 23 bp, Artificial Sequence
  forward primer
ctggtgaggctatgtacgctttt

SEQ ID NO: 65 - DNA, 22 bp, Artificial Sequence
  forward primer
caaatcgatgctgagtgcagat

SEQ ID NO: 66 - DNA, 20 bp, Artificial Sequence
  forward primer
caccacgctgctccaaacag

SEQ ID NO: 67 - DNA, 18 bp, Artificial Sequence
  forward primer
tgggcttggtggcttgtt

SEQ ID NO: 68 - DNA, 22 bp, Artificial Sequence
  forward primer
tggctggatctggagatatgtg

SEQ ID NO: 69 - DNA, 24 bp, Artificial Sequence
  forward primer
ttctgcttcgctttgtctctttac

SEQ ID NO: 70 - DNA, 20 bp, Artificial Sequence
  forward primer
gaggctggattcctcgctta

SEQ ID NO: 71 - DNA, 26 bp, Artificial Sequence
  forward primer
cacactacaagctcaagaaggctact

SEQ ID NO: 72 - DNA, 26 bp, Artificial Sequence
  forward primer
cttgggaggctatgtatgttagaaga

SEQ ID NO: 73 - DNA, 26 bp, Artificial Sequence
  forward primer
atagcatcgaggaacagttgtcttag

SEQ ID NO: 74 - DNA, 26 bp, Artificial Sequence
  forward primer
atagcatcgaggaacagttgtcttag

SEQ ID NO: 75 - DNA, 28 bp, Artificial Sequence
  forward primer
gttcgagtgattatgaggttatttctgt

SEQ ID NO: 76 - DNA, 27 bp, Artificial Sequence
  forward primer
ttctcctcttgtgagttgagtgttaag

SEQ ID NO: 77 - DNA, 27 bp, Artificial Sequence
  forward primer
ttctcctcttgtgagttgagtgttaag

SEQ ID NO: 78 - DNA, 26 bp, Artificial Sequence
  forward primer
ggcttctttaattttgagctcagatt

SEQ ID NO: 79 - DNA, 23 bp, Artificial Sequence
  forward primer
tgttctcggtctcaacacacatg

SEQ ID NO: 80 - DNA, 26 bp, Artificial Sequence
  forward primer
cggttataagttttgtgtagcgttgt

SEQ ID NO: 81 - DNA, 21 bp, Artificial Sequence
  forward primer
gaccccctctctctcgttgtc

SEQ ID NO: 82 - DNA, 23 bp, Artificial Sequence
  forward primer
catccacaaagaaaccgacattt

SEQ ID NO: 83 - DNA, 25 bp, Artificial Sequence
  forward primer
gacgctagttagccttacgtaacgt

SEQ ID NO: 84 - DNA, 25 bp, Artificial Sequence
  forward primer
gacgctagttagccttacgtaacgt

SEQ ID NO: 85 - DNA, 28 bp, Artificial Sequence
  forward primer
catttagacaccaaatatctgctaatgg

SEQ ID NO: 86 - DNA, 20 bp, Artificial Sequence
  forward primer
gacaacatgcatcaatggcg

SEQ ID NO: 87 - DNA, 25 bp, Artificial Sequence
  forward primer
cttcaaacaaagacagcggctatat

SEQ ID NO: 88 - DNA, 28 bp, Artificial Sequence
  forward primer
gcaggtttaggcatatatatacgagtgt

SEQ ID NO: 89 - DNA, 22 bp, Artificial Sequence
  forward primer
cggagtttgtgaaccctaagga

SEQ ID NO: 90 - DNA, 20 bp, Artificial Sequence
  reverse primer
caccgccgttagtcatctca

SEQ ID NO: 91 - DNA, 22 bp, Artificial Sequence
  reverse primer
acttttcaccaccgacgaagtt

SEQ ID NO: 92 - DNA, 18 bp, Artificial Sequence
  reverse primer
cctcccacctccaagcaa

SEQ ID NO: 93 - DNA, 21 bp, Artificial Sequence
  reverse primer
aacacggtcaaagccttcatg

SEQ ID NO: 94 - DNA, 20 bp, Artificial Sequence
  reverse primer
aaagcaacgagtggcaaggt

SEQ ID NO: 95 - DNA, 20 bp, Artificial Sequence
  reverse primer
tgcaagcagctccgaaataa

SEQ ID NO: 96 - DNA, 22 bp, Artificial Sequence
  reverse primer
ccatatcgtgcctcactttttg

SEQ ID NO: 97 - DNA, 24 bp, Artificial Sequence
  reverse primer
ccacaaggaatatctccaggtgat

SEQ ID NO: 98 - DNA, 21 bp, Artificial Sequence
  reverse primer
tggatcgttcacgttgaagtg

SEQ ID NO: 99 - DNA, 22 bp, Artificial Sequence
  reverse primer
attggctcatcggactttctca

SEQ ID NO: 100 - DNA, 24 bp, Artificial Sequence
  reverse primer
aaaccaaggagcgtcaagtctaga

SEQ ID NO: 101 - DNA, 21 bp, Artificial Sequence
  reverse primer
aaagctccgctagcagacatg

SEQ ID NO: 102 - DNA, 24 bp, Artificial Sequence
  reverse primer
ccaatcttatccatagcagcgtta

SEQ ID NO: 103 - DNA, 25 bp, Artificial Sequence
  reverse primer
cagcctcagggttcaaaatagccat

SEQ ID NO: 104 - DNA, 24 bp, Artificial Sequence
  reverse primer
catccaactctccgtagaacctct

SEQ ID NO: 105 - DNA, 22 bp, Artificial Sequence
  reverse primer
atctcggtgagagttgggaaaa

SEQ ID NO: 106 - DNA, 23 bp, Artificial Sequence
  reverse primer
gatctcctcgtcgtatccaacag

SEQ ID NO: 107 - DNA, 26 bp, Artificial Sequence
  reverse primer
ggcttctttaattttgagctcagatt

SEQ ID NO: 108 - DNA, 24 bp, Artificial Sequence
  reverse primer
cagcggctatataatcgttgtgtt

SEQ ID NO: 109 - DNA, 23 bp, Artificial Sequence
  reverse primer
gcagatgtagaagccatggtttg

SEQ ID NO: 110 - DNA, 25 bp, Artificial Sequence
  reverse primer
cacctttgagtttatcgatgaaaca

SEQ ID NO: 111 - DNA, 29 bp, Artificial Sequence
  reverse primer
cttagaactaaaatcaactctttgtgcta

SEQ ID NO: 112 - DNA, 21 bp, Artificial Sequence
  reverse primer
ctctgagccgtgtttgctacc

SEQ ID NO: 113 - DNA, 27 bp, Artificial Sequence
  reverse primer
ccaaaatccagtactaaaatccagatc

SEQ ID NO: 114 - DNA, 20 bp, Artificial Sequence
  reverse primer
ttaggccacggtccgtacag

SEQ ID NO: 115 - DNA, 29 bp, Artificial Sequence
  reverse primer
aacatttagacaccaaatatctgctaatg

SEQ ID NO: 116 - DNA, 26 bp, Artificial Sequence
  reverse primer
tcctagctctttgtctgaagcatact

SEQ ID NO: 117 - DNA, 20 bp, Artificial Sequence
  reverse primer
caccgccgttagtcatctca

SEQ ID NO: 118 - DNA, 28 bp, Artificial Sequence
  probe
catgacaagccagttcagcaagtcatcg

SEQ ID NO: 119 - DNA, 14 bp, Artificial Sequence
  probe
aaggcacatcctcc

SEQ ID NO: 120 - DNA, 27 bp, Artificial Sequence
  probe
agcttcttttcttggacgcccttgagc

SEQ ID NO: 121 - DNA, 29 bp, Artificial Sequence
  probe
tgcttccccaatgtacgttgctaggttct

SEQ ID NO: 122 - DNA, 22 bp, Artificial Sequence
  probe
ttggagcacgatgtggatttga

SEQ ID NO: 123 - DNA, 26 bp, Artificial Sequence
  probe
tcacctcatggctaccaacgattgca

SEQ ID NO: 124 - DNA, 25 bp, Artificial Sequence
  probe
actccatgcacaacaagcaccacgc

SEQ ID NO: 125 - DNA, 25 bp, Artificial Sequence
  probe
tgtgcgtgggtatcgcttaccaagc

SEQ ID NO: 126 - DNA, 27 bp, Artificial Sequence
  probe
aggaacggatacaccgttatgccatgc

SEQ ID NO: 127 - DNA, 26 bp, Artificial Sequence
  probe
tgctttccaccaagctttcccagagc

SEQ ID NO: 128 - DNA, 19 bp, Artificial Sequence
  probe
atcatctctctcggagttc

SEQ ID NO: 129 - DNA, 17 bp, Artificial Sequence
  probe
agacttgcatgttcttg

SEQ ID NO: 130 - DNA, 17 bp, Artificial Sequence
  probe
agacttgcatgttcttg

SEQ ID NO: 131 - DNA, 23 bp, Artificial Sequence
  probe
tttgatttatgagttaatggtcg

SEQ ID NO: 132 - DNA, 20 bp, Artificial Sequence
  probe
tgtaataatggttcactttc

SEQ ID NO: 133 - DNA, 20 bp, Artificial Sequence
  probe
tgtaataatggttcactttc

SEQ ID NO: 134 - DNA, 19 bp, Artificial Sequence
  probe
acccattttacccggtgtt

SEQ ID NO: 135 - DNA, 19 bp, Artificial Sequence
  probe
acccattttacccggtgtt

SEQ ID NO: 136 - DNA, 25 bp, Artificial Sequence
  probe
tacaagtgcgcacagactagcggcc

SEQ ID NO: 137 - DNA, 24 bp, Artificial Sequence
  probe
ctctgccagcgaccaaatcgaagc

SEQ ID NO: 138 - DNA, 19 bp, Artificial Sequence
  probe
atcataaatcagggtttcg

SEQ ID NO: 139 - DNA, 18 bp, Artificial Sequence
  probe
acactagctagcgttagc

SEQ ID NO: 140 - DNA, 18 bp, Artificial Sequence
  probe
acactagctagcgttagc

SEQ ID NO: 141 - DNA, 17 bp, Artificial Sequence
  probe
ctaacctgcaggataca

SEQ ID NO: 142 - DNA, 17 bp, Artificial Sequence
  probe
ctactaccggtaattcc

SEQ ID NO: 143 - DNA, 23 bp, Artificial Sequence
  probe
atcgttgtgttatattcagtcta

SEQ ID NO: 144 - DNA, 15 bp, Artificial Sequence
  probe
acgggcaggacatag

SEQ ID NO: 145 - DNA, 28 bp, Artificial Sequence
  probe
catgacaagccagttcagcaagtcatcg

SEQ ID NO: 146 - DNA, 26 bp, Artificial Sequence
  primer
cacactacaagctcaagaaggctact

SEQ ID NO: 147 - DNA, 29 bp, Artificial Sequence
  primer
cgttgtgttatattcagtctaaaacaagg

SEQ ID NO: 148 - DNA, 23 bp, Artificial Sequence
  primer
tttggtttctttgagcaggagat

SEQ ID NO: 149 - DNA, 27 bp, Artificial Sequence
  primer
ctaattaatagtccgatcaagctgaac

SEQ ID NO: 150 - DNA, 24 bp, Artificial Sequence
  primer
tctcatcgttgttttctccctttt

SEQ ID NO: 151 - DNA, 26 bp, Artificial Sequence
  primer
ggcttctttaattttgagctcagatt

SEQ ID NO: 152 - DNA, 22 bp, Artificial Sequence
  primer
attggctcatcggactttctca

SEQ ID NO: 153 - DNA, 19 bp, Artificial Sequence
  primer
cctattaggccacggtccg

SEQ ID NO: 154 - DNA, 21 bp, Artificial Sequence
  primer
tgggaaaacgtaagcctcctt

SEQ ID NO: 155 - DNA, 23 bp, Artificial Sequence
  primer
tgagagaagggaactcgtaagga

SEQ ID NO: 156 - DNA, 24 bp, Artificial Sequence
  primer
aaaccaaggagcgtcaagtctaga

SEQ ID NO: 157 - DNA, 19 bp, Artificial Sequence
  primer
ggcatggtaggcgcattta

SEQ ID NO: 158 - DNA, 26 bp, Artificial Sequence
  probe
tgctttccaccaagctttcccagagc

SEQ ID NO: 159 - DNA, 19 bp, Artificial Sequence
  probe
cagtgtttaaacgattgac

SEQ ID NO: 160 - DNA, 13 bp, Artificial Sequence
  probe
cgcgccttccatg

SEQ ID NO: 161 - DNA, 16 bp, Artificial Sequence
  probe
cagcgtcttgagcagc

SEQ ID NO: 162 - DNA, 14 bp, Artificial Sequence
  probe
cgctgctgttccac

SEQ ID NO: 163 - DNA, 19 bp, Artificial Sequence
  probe
acccattttacccggtgtt

SEQ ID NO: 164 - DNA, 24 bp, Artificial Sequence
  forward primer
aagacgtccgcaatgtgttattaa

SEQ ID NO: 165 - DNA, 22 bp, Artificial Sequence
  forward primer
ggcgcgcctctagattaattaa

SEQ ID NO: 166 - DNA, 22 bp, Artificial Sequence
  forward primer
ggcgcgcctctagattaattaa

SEQ ID NO: 167 - DNA, 22 bp, Artificial Sequence
  forward primer
ggcgcgcctctagattaattaa

SEQ ID NO: 168 - DNA, 24 bp, Artificial Sequence
  forward primer
gcggacatctacatttttgaattg

SEQ ID NO: 169 - DNA, 23 bp, Artificial Sequence
  forward primer
cactgagcatggtgcttaaacac

SEQ ID NO: 170 - DNA, 27 bp, Artificial Sequence
  forward primer
ctctttctttttctccatattgaccat

SEQ ID NO: 171 - DNA, 22 bp, Artificial Sequence
  forward primer
caattaaccgcggacatctaca

SEQ ID NO: 172 - DNA, 24 bp, Artificial Sequence
  forward primer
aattaaccgcggacatctacattt

SEQ ID NO: 173 - DNA, 27 bp, Artificial Sequence
  forward primer
ctctttctttttctccatattgaccat

SEQ ID NO: 174 - DNA, 27 bp, Artificial Sequence
  forward primer
ctctttctttttctccatattgaccat

SEQ ID NO: 175 - DNA, 27 bp, Artificial Sequence
  forward primer
ctctttctttttctccatattgaccat

SEQ ID NO: 176 - DNA, 25 bp, Artificial Sequence
  forward primer
ccatattgaccatcatactcattgc

SEQ ID NO: 177 - DNA, 23 bp, Artificial Sequence
  forward primer
gacctcaattgcgagctttctaa

SEQ ID NO: 178 - DNA, 22 bp, Artificial Sequence
  forward primer
tgtacggctaagagcgaatttg

SEQ ID NO: 179 - DNA, 24 bp, Artificial Sequence
  forward primer
gcctacctagactcacgtgacctt

SEQ ID NO: 180 - DNA, 22 bp, Artificial Sequence
  reverse primer
acacctgaaagggaaaatccaa

SEQ ID NO: 181 - DNA, 20 bp, Artificial Sequence
  reverse primer
cacacacctccccaatccat

SEQ ID NO: 182 - DNA, 20 bp, Artificial Sequence
  reverse primer
gggatcggagaaatcatcga

SEQ ID NO: 183 - DNA, 22 bp, Artificial Sequence
  reverse primer
caccaaaagcaaccaagagaga

SEQ ID NO: 184 - DNA, 28 bp, Artificial Sequence
  reverse primer
gctatttgacttcttcatctgtgtgtct

SEQ ID NO: 185 - DNA, 29 bp, Artificial Sequence
  reverse primer
agagcgagagagaggaagtaggtatataa

SEQ ID NO: 186 - DNA, 24 bp, Artificial Sequence
  reverse primer
ttaacgaaatcaaacaacgacgtt

SEQ ID NO: 187 - DNA, 26 bp, Artificial Sequence
  reverse primer
gcaaaacaacaagagcaagaaatact

SEQ ID NO: 188 - DNA, 22 bp, Artificial Sequence
  reverse primer
cgggcagtgagtagtctgagaa

SEQ ID NO: 189 - DNA, 24 bp, Artificial Sequence
  reverse primer
tgaggcatgaagaagcaaattatt

SEQ ID NO: 190 - DNA, 26 bp, Artificial Sequence
  reverse primer
gcagtgactcatcaaaacaacttttt

SEQ ID NO: 191 - DNA, 28 bp, Artificial Sequence
  reverse primer
acatttttattcctgtatacgcacacat

SEQ ID NO: 192 - DNA, 26 bp, Artificial Sequence
  reverse primer
tggctgatagggttctttcaaatata

SEQ ID NO: 193 - DNA, 25 bp, Artificial Sequence
  reverse primer
cctcaccaggaaggatatagagttg

SEQ ID NO: 194 - DNA, 17 bp, Artificial Sequence
  reverse primer
cgtgccaaggcatccaa

SEQ ID NO: 195 - DNA, 23 bp, Artificial Sequence
  reverse primer
aatgagagaagaaacgcaagcat

SEQ ID NO: 196 - DNA, 17 bp, Artificial Sequence
  probe
tctaagcgtcaatttgt

SEQ ID NO: 197 - DNA, 23 bp, Artificial Sequence
  probe
ttactaatcagtgatcagattgt

SEQ ID NO: 198 - DNA, 23 bp, Artificial Sequence
  probe
ttactaatcagtgatcagattgt

SEQ ID NO: 199 - DNA, 23 bp, Artificial Sequence
  probe
ttactaatcagtgatcagattgt

SEQ ID NO: 200 - DNA, 22 bp, Artificial Sequence
  probe
tttctccatattgaccatcata

SEQ ID NO: 201 - DNA, 19 bp, Artificial Sequence
  probe
ctggtgagttctagtactt

SEQ ID NO: 202 - DNA, 19 bp, Artificial Sequence
  probe
atactcattgctgatccat

SEQ ID NO: 203 - DNA, 25 bp, Artificial Sequence
  probe
attatccaaaagagctattcaacct

SEQ ID NO: 204 - DNA, 19 bp, Artificial Sequence
  probe
atactcattgctgatccat

SEQ ID NO: 205 - DNA, 19 bp, Artificial Sequence
  probe
atactcattgctgatccat

SEQ ID NO: 206 - DNA, 16 bp, Artificial Sequence
  probe
cggacatgaagccatt

SEQ ID NO: 207 - DNA, 19 bp, Artificial Sequence
  probe
atactcattgctgatccat

SEQ ID NO: 208 - DNA, 25 bp, Artificial Sequence
  probe
taaattatacttgatcggtcatctg

SEQ ID NO: 209 - DNA, 20 bp, Artificial Sequence
  probe
ttcaaactattcgggcctaa

SEQ ID NO: 210 - DNA, 18 bp, Artificial Sequence
  probe
cgagctttctaatttcaa

SEQ ID NO: 211 - DNA, 18 bp, Artificial Sequence
  probe
tagcgtcaaagctttaca

SEQ ID NO: 212 - DNA, 1100 bp, Artificial Sequence
  flanking sequence
atatatattaacataaacacttattaaaataaaattatttatttatatgatcatttcttattatagaaaaaaatttaaacattgatcataaaagtatgtgagacttttaatagttttagtaatttatactcgttttgaaaaattcaaaatacaacatatacaaaaaaactaaaattttaatatatgattaatgtaattgtttaatttataataatagtaaagaattaaacaaaaattatagaaagcatacatattattagcaaatcttcattatttaaaatcattaattactatatatcataatcacattaggtaattctgtaggtttttatttaagaaaataatatataataaatagcaaccttgctatatcatatgatatcatatagttggtattaaatgtttctagtgacatataaaaatcgaattggacgaacatgtttttcaatttcagtgtgggactgacacatatgactaattaactatctaattgattgacacataagcaaaatatattttttaactattacaaaattaaggttatatcttttcaaatgttcctcaattaatatataggggattgttcataacccgaaacgacaatcaatttgtttacactcaaacactgatagtttaaactgaaggcggggattggggaggtgtgtgatttgcttagcttatgatatgtttaaacatgaaggcgggaaacgacaatctgatcactgattagtaactaaggcctttaattaatctagaggcgcgccgggccccctgcagggagctaagccggccaatttaaattgatatcggtacatcgattacgccaagctatcaactttgtatagaaaagttgccatgattacgccaagcttggccactaaggccaatttcgcgccctgcagcaaatttacacattgccactaaacgtctaaacccttgtaatttgtttttgttttactatgtgtgttatgtatttgatttgcgataaatttttatatttggtactaaatttataacaccttttatgctaacgtttgccaacacttagcaatttgcaagttgattaattgattctaaattatttttgtcttctaaataca

SEQ ID NO: 213 - DNA, 1226 bp, Artificial Sequence
  flanking sequence
gttaattatagatatattttaggtagtattagcaatttacacttccaaaagactatgtaagttgtaaatatgatgcgttgatctcttcatcattcaatggttagtcaaaaaaataaaagcttaactagtaaactaaagtagtcaaaaattgtactttagtttaaaatattacatgaataatccaaaacgacatttatgtgaaacaaaaacaatatgtcgaggcgatcgcagtacttaatcagtgatcagtaactaaattcagtacattaaagacgtccgcaatgtgttattaagttgtctaagcgtcaatttgttgtcggcaagatctctgacactcaactaaaatgttggattttccctttcaggtgtatgctcacaaggtctataaatatcttgagactccactgctgtctctgagtgagataagagacaacgaccgtattgtcgcatataggttcaaccagatgcacagaggaccaggaaaagccaaactagagattcttcactcggagcagaaacagtaagcattcgagaattctttaggttctgtctatctttcaaatctcacaggtctgattttggcagagacgcagagatttctggaaagttatttggaattccccttgttacttatgtcaactcagaacgacatagtggaagtgacattgatgcaattatttctggattgctatcaccgctacaccggactcattcatcatctggaagcttagaggatactacagttggtgaaaaagagttttctttcagcgtcttctggttagatcgttattcttccagtctcaagccacttgagtccgattttgttccgaatcctcttagtgctacaaggctcgtagtcaagtgggacgagaaagagcatgaaaaatatgattcaagcagctacttgaatgatctacctgaggtttataaagcaacttcctcggtggcggaaaaggtttctttgttttcatgcttggaagcctttctagcagaagagcctctcggaccagatgatatgtggtgttgtcctgcttgcaaagaacacaggcaagcgaacaagaagctgaacttgtggaagttgccagagattcttgtgttccacctaaaacggttcgcctataccagatttttaaagagtaagattgatacgttcgtggattttccgattcatgacttagatttaagcaagtacgtgaagaataaagagggtgagtcgtatctttacg

SEQ ID NO: 214 - DNA, 2100 bp, Artificial Sequence
  flanking sequence
acatcatcttgcaaccgacttgaataatcacgtccaccaacctaacaacagaggagaagaggttatcatcgcagatggctccctcttctcatcgcagatggctcaggtcttccaatcacacatattggttcctccattgatcacaaaaattttaaaggaatttttaacattttttgtaatttaaagttgttttaaaaatttcaaagtataatatataagaaaaaatctaatttttattattatatggttaatgtgattgtttatttttttaataatataaaattaaacaaaaatgaggaaagatgcaaaagttgttatcaaatctttattattcataatcattaattgtcatatatatgttagttatattaggtaattccgtagcttttatttaaggaaaaaatacacactgtttttattttgggttaatataactttccctagtaattggattttacaccaacattttttcaattgattcttaagctgccatgtaagctaaatttgcatactaattaagtgacacctaagtagggtttctttttaattagtacaaacttaatgttacaattttttaaatgatcttcaattaatatataggggataagacacaacctcctcttatgattgtgtaatattaatagtcctcatataccttcaattatttatatgcagtagtagatgcagtatgaagggaagaggtgtgattcggagatgcagtagtagtcaattggaaccgaagaatgagaggaggaggagtgtgggttattgtcgctgccagatgatgtggctttggattgcctggttcaggtgtcgagactggacctggtgggcttagccatggtttccaggagccaccggtttgtggcagagtcccgcaatatcatggccatgagatatcggctgggtaacttggacccatatttgtgcgtatttatacactccaagcccaaggtggttcgtcctccacaccctgcaacattggctcaaaccggtccattcaagcttgtatccggctccactagccggatcctgttttgtgacgacggattggggtatctattgtatcggtggattcatgaacggcaagcccacatcggaagtcacgttttttaatgctatcgaccacagcccttaccgagctgccccaataaagatggctcgaagcggatcatccgcaagcttgataaacaagaagaaggtatttgtatttggagggtgttgggatgtcgctaattcttcaaactggttagagttatatgattttaaaactggaacgtgagagtttttgtttgtatttacgcccaagatgcccctcaacatccaacaaagtgtggtgatagaaggcaaggttgtttatggggtggatggggatggtcaaatctttcacttcacaccgagtactactagccttatgtttactacagacggaatagttgagcctaacccagaaaatagaaacgattggtttttatttgaggtaataatgtgccgtggtatcggcgggagaatactgtggcgttggccagatgagattctttagaaagaagtcaaaggtttggaagagctgcagcaacaacacatcatcaaaatctgctccttctctgagaagacgattgccatcttctgggatgcccggtggcctcaacaaggtctaggagctttggtatgccgagatttccatgaagagacaccagggagacgaggggtggtggaaggtttgggggaacattgagagttccgctgctgttatctcagactcatcgcatagttcctttaacttgttatatgctgctactgtctttgcctgaattactattctcaagcaatcctttggttttttatataatttgtttctattttatcttttgattgcaacatgttatcacaaaccaaactaatcggtaacgttattgcttaaacatatcataagctaagcaaatcacacacctccccaatccatggatatgttctctcttttctcaatcaatttgtttacactcaaacactgatagtttaaactgaaggcgggaaacgacaatctgatcactgattagtaactaaggcctttaattaatctagaggcgcgccgggccccct

SEQ ID NO: 215 - DNA, 2065 bp, Artificial Sequence
  flanking sequence
gtatcactatttttcagcatgtagtccattctcttcaaacaaagacagcggctatataatcgttgtgttatattcagtctaaaacaaggcgcctactaccggtaattcccgggattagcggccgctagtctgtgcgcacttgtatcctgcaggtcaatcgtttaaacactgtacggaccgtggcctaataggccggtacccaactttattatacatagttgataattcactggccggatgtaccgaattcgcggccgcaagcttgtacactagtacgcgtcaattggcgatcgcagtacttaatcagtgatcagtaactaaattcagtacatcaaccgtatttagttttaatttttataagatttttacacaattataactttgtttaaattaaaattttattataatatttttaggtaaataaaaagtgtggttctaatggtaaatttctctgtctgctccatctatgacatcttttgcggttatcacctttgctctttgttagcatcatgttttttgtaacttttttaattctggtttgtggcagtgggctccttttcatctgttttggcaatgacacagctggttgcttttgaaatcatgctctgtgtttatggctggtgtgttgtttatgatacatttggttgtgtccctgaatccttgtgttgcagttgtttatgatagatttggttgtgtcctactattgtttgcgttcggattgcgattttggactggacttggtttcttagttgtatttcatttcgaaaaattgtaactcgttatattttttttttctttttgttcttagggaagaatgattattgctcatttatgtgatgagctgaaagaactgaaaacaattatgtgcatggtaatattcctttgcacttgcaaacgcaataaccgcaagattgaatgatgggtaggtaaatttttttttttttttttgtttatggtcattgcataacatacttttattggaaattgtcttctcttaagaatgaatgggtggtttgagactattggagataaaatgattcttgggagtcagattcttttaccaatatgtgtacacttttttaagatagatgtttaatgtagtatttttatttcttatattgtgtatatacttattatttgttttttccttaattatatatttacttattttattttttttgtttttatatcaaatggtaatattacgatagatgtttaatgtaatatttatgtttcttctattctatatttacttattctttattttttgctgtaatataataatggaaatgataaaaatgtataactatagatttttcagatagatgtttaatgtaatattccatttcttatattgtacatttaattattatttatttttcttatattatatatttatttattttaattattttgcctttcatcaaatggtaatattatgatagatgtttaatgtaatatttatttttcttctattgtatatttacatctttttatgttttcttataatttaatataaaaatgtaaaactatacatttttaaatagatgtttaatgtagtatttccatttcttatattgtgtatttacttattttaattttcttccttttatatcaaatagtaatattacaatagatgtttaatgtaatatttttgtttcttttattgtatatttactttgtttttataatgtattaatgtcgtgtggcatcttttggaagaaggattttatgttgagatgaacattccatagagcctcaaatagtctcttttattagtactagaggttggtccgccctacgggcgggttaattacactaaactatttcatattagaatatattttaattttataaaatatttgaatatttactttatattaaaataataaatacaatctatttttatttctttttattctaagatcatatcataacttttattaaaattttttggttttaattataaagatcaataacatttttttctgagaaaacaaaattaataaattaaagttaatgaacatttaatgatttatatttttctatttgatttatatttcaa

SEQ ID NO: 216 - DNA, 1500 bp, Artificial Sequence
  flanking sequence
atgtatgtgtagattcttgtaattttgcaataataaaaaaatgtggcttagattaaaaaaaagagttatatatgttgtttttacattaggtgaggactctgttgtaaaaaaaatgtgatttgtttttttatagatgtggtaattttatatatatctcaaggtctcttgtggattagatagagagtgaatgattaaatgtttttaaagtgggctctcctattgcaataatctaaaaataaaggtttgtttgttatacacaataatttttaagagagaattttaaacaaaaaatattactccaatcaaaaatagcattttctaaaaaatatctcattctcaattgatataatttcttcttttcatttgttcattttatactacttatttttggtttaagaaacttctaaaaaaccttcaactgaaaatgcttttatgcttctaacatttatttcaaagacttctgatttatgtttggaacaaatgaaatagagaagcaattccatgaattgaagtgattaatgtatgttttgcaacaattaaaaatgttgcttgtaagtttgcaacaatttaaaaataaaaaggtctaatctgtttttcatttttcattttttcacatttaggtgatgagtagttgtagtataacttaaatggtggtttgtcttgttatatttggttgtcatttctttatttcaagatctttgattttttttttttacaaaacacatggaatgaattccatgcatttgttaattgttttggaattttttttgtactctatttaggtgttaggactctactgtagtatgacctaacatagtggtgatatgttgatcaaattttgtgtgacatttatatgaaggtcttttgatttatatttagtaaaatgaaatagagagggaagtttatatgaaggtctccagaaattgaagtgactcatgaatgtttagttaagtaaagatcaatggactttcatcaccaaatatatattttttaaactatacaaaaaaaaatcctttttattttaaagaagtttaattatatttaaaaatgatttaaatgtacgtaataattataaacagaatattcttttgtagagtggacctaatgcaagtaggcaagatccgacaaaacaagttaaagacacaccccaccaaaagcaaccaagagagacgtctttaatgtactgaatttagtaactgaaggcgggaaacgacaatctgatcactgattagtaactaaggcctttaattaatctagaggcgcgccgggccccctgcagggagctcggccggccaatttaaattgatatcggtacatcgattacgccaagctatcaactttgtatagaaaagttgccatgattacgccaagcttggccactaaggcaaatttcgcgccctgcagcaaatttacacattgccactaaacgtctaaacccttgtaatttgtttttgttttactatgtgtgttatgtatttgatttgcgataaatttttatat

SEQ ID NO: 217 - DNA, 1948 bp, Artificial Sequence
  flanking sequence
cggccgagctccctgcagggggcccggcgcgcctctagattaattaaaggccttagttactaatcagtgatcagattgtcgtttcccgccttcagtttaaactatcagtgttgctttagtggtcaatcaaaagatgaacagtatcttctcgatcgatgatttctccgatcccttttgggaatcttctccgcctctcgattcggactcggccaaggccctcacggcggaggaatggaccgtggagatgtttttcgaagagatcgcttcctccgtgacctctgcgcctgtcggatccaacaacaacaacaacaacgcgatcgtcggagtttcgtcggcgcagtctcttccttccgtctccggacagaacgatttcgaggaagacagtcggtttctccgtcgcgaatcagatgattaccgtcgcgttcttgagaacaagctcgagactgagtgtgcagctactgttgtagctcttagggtttgtcttctgtttctcttttttttatattgcatgtgtaagaagaagaagaagatctgaatcttaaagctttgtttgttctctctgcttgtgttgtgtaggctggttctgtgaagcctgaagattcgactggttctcctgagactctgtttcaaccagctctgtctagtcctcttactcaaggtaataggtgctcatcatgcaaattagttttttacactacatagcttgtctcttagcttcaccatgtttgaaattttttatgccaagaaagtgttctaaaaatcggtctaggcgcctagtcggcaaatcgggtctgtacgaaatgattttttcaaatcgatttgaaaatcggtctagacgtccgcctaaacaataattatagcgataaaattaaggatttgtaatgtagagatggaaaaaaaaaattttgttcaaatagagaaggaaaatggttctttagagaagcttgaaaccatttcaagtctccttgatatattttttttgttggagcaagtttctaattttatcataaagtttcaatactttttgtgatattttccttgaaattaatctgacttttttaaggccaataagattgggatggtgttagttcaatatctttctctttgtttcgagtctttacacatagtacgtttaatggtggtaggttctttggtgacgcctggagaagttggtgtcacttcatcattactagctgaggtgaaaaaaactggtgtaccgatgaagcaggttactagtggatcgtctagagattattctgatgatgacgaccttgatgaagagaatgaaaccactggttccttgaaaccagaggacgttaaaaaatctagaaggtaaaatgattccttgtttcttgtcttttgatgtttatctttatagaaccttgttgtttgtaggatgctttcaaatcgagagtcagctaggcggtctagaaggagaaaacaggagcaaacatgtgatctcgaaacacaggtttctataaatagatcctctcaacctcctattaacatctccaaggatattaatagaaacttaatttttgtgtgtgttttgataggttaatgagctaaaaggtgaacactcctcacttctcaagcagcttagcaacatgaatcacaagtatgatgacgctgccgttggcaatagaatactaaaagccgacatcgagacactaagagctaaggtaataacaccttcttttttttcataaccacactaatgttttgttactataactaattgtatttgatcaaggtgaaaatggcggaagagacggttaagagagtaacaggaatgaaccctatgcttctcggtagatcaaatggacataacaacaacaacaatagaatgccattaactggtaatagcaggatgggtggttcttcatgcatcccaccttttcaaccgcaatcaaatccaaacatggggggactaacaacaaccattcta

SEQ ID NO: 218 - DNA, 1600 bp, Artificial Sequence
  flanking sequence
caagaccacaagattgcatctctttgaaagtctcttcagcccttttgaaatctccttggcaacaaaatccattaacaagagatgagtaagtcaccacgtttggcttacacttggtcttacccatgtctcgaaaaatctttaaggcggtagtcatatcctgttgcttcacgtacccatcgatgattgtggaataagtgaactcatcaggtacaagtctttcttcggtcatcctattcatacacatcaatgcctcattcaacattccggatctgcaaaacccctttatcatagcgttgtggtgcacgacatcaaccttcacacccttttcaattgagagagaggaaaccttctttgcttcctcaaaatcaccgcttctgatgaatccatctatgagggtagcatacacataagcatccggtgaaattttccggtctaacatctccaagaagaggagcttggcagatgaaaacccacctctcttacacaacccactcatcaacatattgtagatggcagcatccggtgaaactcctctctctatcattttacctttcatcttaattgcatcatccatatgacctgaagcgacaagaccatggataagaatcccatacgtaactatatctggtttgcaacctctctcagccatctgcagaagcaacttagaagcaatatcatactctttgactctgcaataaccttgtattagaggggcataggttatattgttccgaaccaaccctctctttgcagcttcatccaaaatcccaacagcatcttccatcctaccttctttacataaacgattgatcaaaatattatatgttgctatatcaggcttgcaaccattagctactatccaccgtatactctcagctacttcaacctttaaaccatgcctatacttagcatccataatattgttcagaaaccaaacactgacaactaaacccctttctttcacttccttcaaaagccgatcactcgccacgaaatcccctttcttgcagaacccattaatcatcgcccccaaaagtctccaagagtcggcataaaccccttggacttcaactccttgaaaaccagactcgcgttctcaacatcagccatcttgcagtatccactaatgatggtgttgtaaaacacaatattcggaacacaacctttcccccatcgctcttcaatcagcttcctaccttcttctaccttcccttcgctacacatacctttgagcaatatacaagtgctgtaattatcacctctctcacgcagttcggatttcgttaaaatctaatattctacaaacccttttatttttcttttgaattaccgtcttcattggttatatgataacttgataagtaaagcttcaataattgaatttgatctgtgtttttttggccttaatactaaatccttacataagctttgttgcttctcctcttgtgagttgagtgttaagttgtaataatggttcactttcagctttagaagaaaccatggaagttgttgagaggttctacggagagttggatggaaaggtttcccaaggagtgaacgctttgttgggatctttcggagttgagttgactgatacccc

SEQ ID NO: 219 - DNA, 955 bp, Artificial Sequence
  flanking sequence
ttttgaacaagtaaatccaaaaaaaaaaaaaaaaatctcaactcaacactaaattattttaatgtataaaagatgcttaaaacatttggcttaaaagaaagaagctaaaaacatagagaactcttgtaaattgaagtatgaaaatatactgaattgggtattatatgaatttttctgatttaggattcacatgatccaaaaaggaaatccagaagcactaatcagacattggaagtaggattaatcagtgatcagtaactattaaattcaattaaccgcggacatctacatttttgaattgaaaaaaaattggtaattactctttctttttctccatattgaccatcatactcattgctgatccatgtagatttcccggacatgaagccatttgtcaacgtcgttgtttgatttcgttaaggggagagcagtccaagtgtgtttttaatctcagataggcctaacatctagatttatttcagactaacccaaaaccgaaacttttgcattcaagtcatctttcgtgttgattcgtaattctttttttcacattcaactttttggtagcagcaggttcagaagattcattcggtttttcaatgtttcagagtaacactagatttgtttcagattaaaccgaaaaatcggattcgttcagaagttttatttggtatgactatgttccggtatgtgatcaataagaaccacttgagttcggtcgagttgttttttttttttgaacttttgtatctgatcagttcggatagactcgaaaaaggaaaagtaaagtctaatagacatcaatattttgacaaaatatcaaaaaatcaatatacaatactaaaaggggatataagccatggagagggtatccacgtaagataggaaaatcaaccaatcagagaacccaaaattttcacatcatctcaattatttttcgtaaaaaatacaatac

SEQ ID NO: 220 - DNA, 2199 bp, Artificial Sequence
  flanking sequence
aaactgaaactttcaaattccaaagttcgatcagtgtttctaataatcagcaaacctgttgaagaagacaaagtaattggcaaagtaaattccattatttcataccctcttctttgattctagtgaagaagacaaatcaaaatattaatcttctgctaaaaaactgaaactttcaagttccaaatttccaaaaaacacatttctccttaatagaccttttaacatcaattcaaactacagtccacaagcttttcacatgaactggcacaataaactgcattcatattctttggttctagtgaagaagacgcatcaaaaactgtagcagctaaaaaaaaaactgaaactttcaagttccaaagttgtaccagtgtttctaataatgagcaaacctgttgaaagcttttgacggttttgccaagactcttgccaatctcaggaagcttcttaggtccgaacagcaacgcagcgactccagcgatcacagctagctcagggacaccgagaccaaacagagcattacaagttagtgcatttctcctctgctccggtcggaacgccactagagaacgggtgtatggtcgagtcgtcacagtgaagcagttgtagtagaaggaagagcgagatgatgagagaggcaaagaaactgctgtgagagaagaaagagtcgcaacatttgtcgccattactgctatcttctggttctgatgttatgtgtgttttctatgagtttttatccaattaaatattcagaaatgttatagaaactaaattaatcttcttattgtctcaactctacatgcagtacaaaactcatctcatacgtagaaaagtagaaattaataggaaaactagatcatcactcgcccgggcggacggatttttattcctttgcaaacgcggattgtaatttttttattgtaatgcaaaaattgctataaaacttgtattttgattttttttgtgaattatgaagttaatttttttaaaacaattattacataattgctcagtgaattttattatattctaatgtctaatatattttgtgtattaaaatatgagatccaccgtaaaaattcacttaaaagaagctgttatgtttctaatttaataagatagatttttaataccatgtttaaaatatatattataaacccatgaactatgttattttgtatgaatacttacttaaatttatgtttagaatttataaaattgtacataaaattatttaactcttgatgcttattattggttgatgatatattctctaataaattatttaattattcaatattgacatgtcaagctgtttaaattgatgagtggggtcggttgaaatttaaaatttccataccaatataaagatgaaattcgatgttattggtttggtgtttcattatattttggaaagaaaccgataataaataacagcacaataaacaaatgaatatttttaatttagtctaatagtcgatgtatatatgtaacggtcccacccacgattttcgtggttacttgttagtccatatctcaaattaccattctaccgttaatgaggagtatttattttttgaaaatacaatggcattttaagtaatatgccatgtaaaagtaagggtaaatattagcagtgatcctgaattaataatattgatactagcaaatgttttattattatcaaatttgcagataaacatgattaattctactaagttcactaacaggaattaaatagttttagaaaatttagggagtgtattcaaagtttaaggtgatttgtattaaaatgacagttattcaaacatgatttttaaatattcaaaaatctagtgttattaaaattgttatttgataaactacccagtcagcatcatcacaccaaaagttaggcccgaatagtttgaaattagaaagctcgcaattgaggtctacaggccaaattcgctcttagccgtacaatattactcaccggtgcgatgccccccatcgtaggtgaaggtggaaattaatggcgcgcctgatcactgattagtaactattacgtaagcctacgtagcgtcacgtgacgttagctaacgctacgtagcctcagctgacgttacgtaagcctacgtagcgtcacgtgagcttagctaacgctacctaggctcagctgacgttacgtaacgctagctagcgtcactcctgcagcaa

SEQ ID NO: 221 - DNA, 1748 bp, Artificial Sequence
  flanking sequence
aaacattttttcagattttgaacaagtaaatccaaaaaaaaaaaaaaaaatctcaactcaacactaaattattttaatgtataaaagatgcttaaaacatttggcttaaaagaaagaagctaaaaacatagagaactcttgtaaattgaagtatgaaaatatactgaattgggtattatatgaatttttctgatttaggattcacatgatccaaaaaggaaatccagaagcactaatcagacattggaagtaggattaatcagtgatcagtaactattaaattcaattaaccgcggacatctacatttttttactgctattctttcatattagcaactggttgattactgaattagtacagatgtaactaacatatatattggatattattattatccaaaagagctattcaaccttttaagcatatgtatatacatgtttaattgattttattagtatttcttgctcttgttgttttgcttatatttttgtaatgatttatttatttttagttatttagttttatcaaagtggtgattaagagaagccacatgactaataccttgttctccaactttttggttaaaataaatttatctaagatatattttgatcgattgatatgaatgttattataacatttacaatttaaaaaatacagttttttctttctcatttacattgtttcctttaggggtgaacacttctggttattttatcggttcagtttagattcggttcgatttggttaattcagttttataaatttttccaactggagtaaccataattaattatggtttgaatcggtttaatttaccttaatcagatccagtttaattttttttttaaaaaataatattttataacacatggtggatataaaaaatgaactatgtaaattaaatctaataaaaaactgaaacacaatcttaaaaaaccacaaaagtttataagaacacaatcaaaccaaaataaatagaaaactaaaaacccaacattgttaacacagttaatagtgactttagttttagaatttagtatattgtatattgctattatgtttaatgtaaataataacaaaaatacattgtttttttggttcagttcggtttggtttgttcgagttgagaaaatcttaaatcaacctatttgataatagacgttggtttggttcggatcgatttcggttcggttggtttgatttgactcggtgttcactgaatacaatttattctataacttatttgtcatactttattatcctgtaatagagttccggtttaatttggggtttggtttgtgtttgatccggttttgttaactcgggtttgataaaactccgaattaaatttggtttggttggtacgttttagttcggtttaatttccaaatctataacacttgacaaaactcacatcctcgctcttccttcccccaaccctaacaaaaaccttcacgctggggagaaaaaaagcaacaaccttcaccgtcgtctgctgctcctcaccaccgcgccgtcgaaaattgacctctacccattactaggtaagcttcccagacccatcctacatcctcaattcactaaacaaacgctaaagtctctacctttatctcctccaatcgtagatctaaagctatggctatctcccaagatctctacccttcccaagaagacctcgtctacgaggaagagatcctccgaaaccccttcagcctcaagctctggtggcgctacctcatctcca

SEQ ID NO: 222 - DNA, 1500 bp, Artificial Sequence
  flanking sequence
aaagagaaagcaaagtggcttcgccgtgatcgccgagagaggtcagaagtaaattaaaaaaaaaaaaaaatcaagagctaaggctcgagagagatggcgtcatcatagactaatcaccgttagaagattagtaggaaaaaaaaagatgacacagagacgaaagatcttaacagttgaacacgtggcggaaaagcgaaatccgatttaacagatcggaaaataaaaaccggcgagattaaagaagaaaggagatagagagaagaggtaccttagatccggatcctgtagatgtggagcagctcgcttggagactggtgtcctcgaatccatcagccgagggagacgcagatccgccgccgctccacgagagcggcgtcttcggactgcctctagcggaatcaacatccttcttcaacgaaacgacaccaaatcttgacgaccgagaccgccgttgacggactccccaccgcaacggaggaaggttcgtcgatggatcttccgaaaccaccgtcccagcatgcttcagccggataagaagctccacgaccatctcgtcgtccgtcatcgccgccgccacccactcatcgttgaccaacatcttagccgctgccgatgtaactttcttcatcgacgctaactgatcaaatctacagctcccggagaaaaagggaatcagatacagtatagaaggagcgagagagaatgaaagagaagttacagaagagagagagaaaatgacgaagaaagacagagggaagtttgatgtatcgatatagaggagagaaaaaaagatacatgggtggtgttatatacgaggctatctaacattattcttctttttatttttatttttatttttatttttccttgtttcattttcatttatattttgatttattttccattttggaaatattttaatcaaatacaatgtgggaccttcttggaaagtatatctaaaattatatgtgaagattctcctaataaaattatatgtgaagattctcctaataaacctccagtcagcatcatcacaccaaaagttaggcccgaatagtttgaaattagaaagctcgcaattgaggtctacaggccaaattcgctcttagccgtacaatattactcaccggtgcgatgccccccatcgtaggtgaaggtggaaattaatggcgcgcctgatcactgattagtaactattacgtaagcctacgtagcgtcacgtgacgttagctaacgctacgtagcctcagctgacgttacgtaagcctacgtagcgtcacgtgagcttagctaacgctacctaggctcagctgacgttacgtaacgctagctagcgtcactcctgcagcaaatttacacattgccactaaacgtctaaacccttgtaatttgtttttgttttactatgtgtgttatgtatttgatttgcgataaatttttatatttggtactaaatttataacaccttttatgctaacgtttgccaacacttagcaattt

SEQ ID NO: 223 - DNA, 1323 bp, Artificial Sequence
  flanking sequence
  misc_feature (578)..(578): n is a, c, g, or t
actcttgtaaattgaagtatgaaaatatactgaattgggtattatatgaatttttctgatttaggattcacatgatccaaaaaggaaatccagaagcactaatcagacattggaagtaggattaatcagtgatcagtaactattaaattcaattaaccgcggacatctacatttttgaattgaaaaaaaattggtaattactctttctttttctccatattgaccatcatactcattgctgatccatgtagatttcccggttctttttctcagactactcactgcccgaagccactactactacacacattattatctctctcacatctctactatttactcttggattccgcaaagtaagtaaaaaaaaaagaaagcaaactctgcttctcaaatctctctctacccatttgctctctcacattttcctttgaccaaaactgaatctttacttcaagcagcgtaaggtgctcgctcctttttgttcctctgactttggttttgatatgaagttttcatgaaactctttcattacacttgctttttgaaaaaaaatgatgtagctttcctggaaaatntagtttcttttcattatcttgggatcttgtgatagattaaatgttatgtttacagttcttcatacctggtggtcaaactctctttttctttgtttttgtaagttttaaggtttaatgtttaaagctatttctgtgatgcactgtgattgtttgctaatgctttactttaatcaatctgatgattgtttgcttcactcaagtggtttttataaattagattctcctttttcatggaaaaaaattcatccaggaatccaaatagattttatttttttgcttgtcttgtctttgagtggagtattaaatctatttactttatattaaatttttttttatgtaaaaagatatttaaactcaattatgtgattcatgatagtagttcttcaacgtctactaggtcccctcctttcacgccaataatggaggagatgatgaaatttaacatacaaaattacagtttaaccctcttgtgttccatttaggattaagaatctggtagggacataaaacgtaaatctaccatattgtgtgctgcttgtgtagtttgtgtaggacccttggttaccaaccttcatgatgataggttgtgaacattacatagtcaagaggagttccctttttttatgactttattatagtcaaacaacttgagtagttaacatcaatggtttcaatgtcaagatatgagttaagtctttctttattttgtttggttttatttgggtaaaactccagaaatgaaagc

SEQ ID NO: 224 - DNA, 1100 bp, Artificial Sequence
  flanking sequence
ttgagtttttgaaatttataaccctttgtaaatctaagttttaggaaaaagtcgttgaattatgaatcgtttgcttttaccacaagctgctcgatcaatcttttagagttttcaaatctaaatttaacacaaaaaaatcaatttttagtttttgaattatgtttccattgctgcgacagcttaaaaaataatccattttttatcgtcttccatcatttgtctccagctttcggagtggaaatgagttctcttagactcaagttggagatgatttcaaattggggcgttggaggaactttcattctttaacagtttataaagtttgtaaatcatttacaaagtttttaaatcatttataaatgtttataaattatttgtaagagcatataaaccatttataaggtttataaaggtatgtaaataatttatgagggtttataaaatgtttattaagttcataaaaaggttttataaagtttagaaacaatttataacgacttattaatcatttataaagagtctataaacgttttataaagggtatgtaaatgttttatagacccttataaagtttgtaaaccctaatagaaccccgacatgaagtttataaaagaacagtttaggcccgaatagtttgaaattagaaagctcgcaattgaggtctacaggccaaattcgctcttagccgtacaatattactcaccggtgcgatgccccccatcgtaggtgaaggtggaaattaatggcgcgcctgatcactgattagtaactattacgtaagcctacgtagcgtcacgtgacgttagctaacgctacgtagcctcagctgacgttacgtaagcctacgtagcgtcacgtgagcttagctaacgctacctaggctcagctgacgttacgtaacgctagctagcgtcactcctgcagcaaatttacacattgccactaaacgtctaaacccttgtaatttgtttttgttttactatgtgtgttatgtatttgatttgcgataaatttttatatttggtactaaatttataacaccttttatgctaacgtttgccaacacttagcaatttgcaagttgattaattgattctaaa

SEQ ID NO: 225 - DNA, 1413 bp, Artificial Sequence
  flanking sequence
atatactgaattgggtattatatgaatttttctgatttaggattcacatgatccaaaaaggaaatccagaagcactaatcagacattggaagtaggattaatcagtgatcagtaactattaaattcaattaaccgcggacatctacatttttgaattgaaaaaaaattggtaattactctttctttttctccatattgaccatcatactcattgctgatccatgtagatttcccggacatgaagccatttacaatccatgtccttataaatggtttatatactcttataaataatttgcttcttcatgcctcaagaatattactactttcaagaataggaaaatctgtgtactaaaaacttcatctcgggttctatcatattgtggtactatcagtaggtgactctgtgtttctatctgcaacataaaagcatgaaactaataagattgtacaattattttataagtctttataaatgtaaacaatgtaataaaatctcagacattaaatgaataagttttgactattattttataagtccttgaaagtattaaattgtaataaacacctcaaatattttgatacttccagcaatgaggaagtcttgagtactagaaacgtcaattcgtgtatgtatcatgtttgacataattaattgtgatctatgcctttccatttgtaacataaaaacatgaactcaataatttctatacaataatttttttaagttcttatgaaaatgtaaaaggagttctaaatatctcaagggcattaccatagacaaccttgtttcgcacaatcaaagagtgtgtacatatatgtttgcaatataaaaacacgaaactttgtgattgtgtcaaagtaaataacaaagccttataaataaaacatgaccaaagagttaacctcagaaattgttgcacaaaaacgaagaaatcttccaatttctttatgtttgctcataaaagaggccacttggagatcatttctaataaaaactgaaagaacctcttttgtaccaaagaacctcttttgtgtattatttataaactcttataaaattgtatccattaataaaagtttataattatttataagtatttacaaattgtagcacacacaagatagcaattgatgtagcttcctcggctaaaacatgatttcctgtaacaataccctttctagctgatctcaaggcaaaagtgaacatttgtttcatcgcgttacttcctcctggcatatctagtgaaagagccacgtccttcaacaagggatatattgcctcaccctctctgtagactgtacagagaccatgcttgtgatcagaatcaaacaaactcatttcaaggtttagttttataaatactactacttaccttaactcttgtggatttagaagggaatgagagaagc

SEQ ID NO: 226 - DNA, 2200 bp, Artificial Sequence
  flanking sequence
agctccccagaacaaaataaaaatcgaaactttgacactacgaaacgatcaattacgagtgaaaagcgaaaaagaatcgaactttaacaacaagagccgtcacaaaggaagagtgtcaaaggtaccacagtattggacatcggtggtggctcgaacaatcgttgagaagacgaggagaagaggaagaatcgcgattctcgacatcgttgatggaatctcggaggggtgatcgatgatcaaaagcccaaaggaggttaaaccaggagcggagcagagtaactttacttctcttttatattctcatggaatgtaggcgtcatcgtgaccgttcgtttagctaggtcattcttgcctttacagtaaaacggacggctagatttcgtttagagaagttatctgatatgaatgattgcacctgattatccgtcataacgaaccatcaggattaaccaactttgactgcataccttcttatttatgacctcttcttccttattttcttaaagatatttatgtaaggagaataaaatttgaatacaattctttttttcatgttggcaagatctaacatggattgtggtatacagattcactaaaacctcgtcactttgtagatagcaagaataatgtatagtctagataacaagaataatgtacatttgttcatgaaattatactgatgaattaagaaccatgaaagcacatacgttaagtttcaatataaataaaactatttgttaaaaatagacatctatttgtaataattagagactaattcatttacaaactgtataagtgcattattgtattattttatttgttgcgtcatgtatcaatataattaattttcttccttcggttgaaaaaatataatcttttattttagcaaagggtttaactaaagaaatataattgctatcaaatataaataaattataatctcattaaactgttcatgttgtctcaagaatataccattaaattttatttgtataaggaaccaaataacacccgtgaaactttacaacttgaaagtaatagtgtactctaagaatgtcaacaaaagttgaaatgtaatataaataaagaaaagacacgaagtcaaacatctatcgaccggtaacagcgtcggcgacaggtgtcatcgccggagacggcaatggagacgaacggcatacgggacacgtaggatgaatcatgagccaagggtcaacgcacttgtcgtggaacaaatggttacaatccggcaaaaccctaatcatatctgtcttcttgtaatccgcgagacatatagaacaacacgacgtcgcagtggcatccttttgcaagctataacccacacgagcctcttcgcacggaaccttagagcatgcgcaacggaggatgaccccgaatccttagcgcttaatggttccattagttttaatataataataatattaagcttaataaacgagcctctgccagtcagcatcatcacaccaaaagttaggcccgaatagtttgaaattagaaagctcgcaattgaggtctacaggccaaattcgctcttagccgtacaatattactcaccggtgcgatgccccccatcgtaggtgaaggtggaaattaatggcgcgcctgatcactgattagtaactattacgtaagcctacgtagcgtcacgtgacgttagctaacgctacgtagcctcagctgacgttacgtaagcctacgtagcgtcacgtgagcttagctaacgctacctaggctcagctgacgttacgtaacgctagctagcgtcactcctgcagcaaatttacacattgccactaaacgtctaaacccttgtaatttgtttttgttttactatgtgtgttatgtatttgatttgcgataaatttttatatttggtactaaatttataacaccttttatgctaacgtttgccaacacttagcaatttgcaagttgattaattgattctaaattatttttgtcttctaaatacatatactaatcaactggaaatgtaaatatttgctaatatttctactataggagaattaaagtgagtgaatatggtaccacaaggtttggagatttaattgttgcaatgctgcatggatggcatatacaccaaacattcaataattcttgaggataataatggtaccacacaagatttgaggtgcatgaacgtcacgtggacaaaaggttt

SEQ ID NO: 227 - DNA, 3137 bp, Artificial Sequence
  flanking sequence
ctgatttaggattcacatgatccaaaaaggaaatccagaagcactaatcagacattggaagtaggattaatcagtgatcagtaactattaaattcaattaaccgcggacatctacatttttgaattgaaaaaaaattggtaattactctttctttttctccatattgaccatcatactcattgctgatccatgtagatttcccggacatgaagccatttacaatgagtcaaaaaaaagttgttttgatgagtcactgctacaataatgtaagatgataaaactcagacctcaatcacagaggcaaacaacaacactcattagtcatgattttttacccaaacaaaaagatgttatagagctttaagaaaaaaaaaaattaaaattacaaatcggtctggtaagagtggtagattgatttttagaagtttatattccttctttttgggttcggtaagaatgatcatcatgcctgtcttgtcttttacaatttccgtaaacgtgcaatgatgtcagattggtaaaagtagctcagctttagctaagcaaattcgaattagtcaaaattaactaatttaatcatcatatatgcttccactgatatgttttcacattgcaatatggctcagcttacttaatatgatgatggttaagaagaaatcgtcaatcataacgagcatttgactagtgcccatgagacctggtgatatgttgtttgattgaagcagcaaaaaaaaaaaaaacacctaagcatgtattttatatatctatgatggaaattatgcaatccagggtctagtaacataactgatgaagctataaaaaaaaaaccatatctaaaaaactatttatacaaaggcaaataaagtgaattgctgctctacatgtcggccacagatggtacggatccaatgtctatggaaaatttgatgcacgttagctccttcttttgcgcgtccagcatcttcatttgcagcgagtatgaaccctataaagataaaataaaaagagtagagaatctgtcaatcttttcctgatttaatatgcacattcaaactagtcattcaatgtctctatgcattggtcaaataccactaaactaagcctaagacatccaatatgatacaagagatgcttcaagattaggtagcaagaaccaataaagaaaaagcgaatggaacttacaggaggagtgtaaccaggaagaacttgagaatgtgcaaccaagaagtctccggtttcaacaggacaagttgtctcagagcaaagttcatgagtctcggagtgaatgtgccatccaaagtatgtaacttcaatcaccagcttcccacccgtaatcccacgccctttattaaaagaaaaacacatatcataaacaacacattcattatcatcacaaaggaaacatctttctatcattggcatcaaataaaaaaaagtaaaaaagaagtaacctgtggtggcagagatggtaaaggtagctccgtagctggctcgccttgagctatagggttaggagatatattaacctctttcactttcacttcatactctgcgttctcctctgcaattaacaaaatacattacactatcaaggcagagagctccccagaacaaaataaaaatcgaaactttgacactacgaaacgatcaattacgagtgaaaagcgaaaaagaatcgaactttaacaacaagagccgtcacaaaggaagagtgtcaaaggtaccacagtattggacatcggtggtggctcgaacaatcgttgagaagacgaggagaagaggaagaatcgcgattctcgacatcgttgatggaatctcggaggggtgatcgatgatcaaaagcccaaaggaggttaaaccaggagcggagcagagtaactttacttctcttttatattctcatggaatgtaggcgtcatcgtgaccgttcgtttagctaggtcattcttgcctttacagtaaaacggacggctagatttcgtttagagaagttatctgatatgaatgattgcacctgattatccgtcataacgaaccatcaggattaaccaactttgactgcataccttcttatttatgacctcttcttccttattttcttaaagatatttatgtaaggagaataaaatttgaatacaattctttttttcatgttggcaagatctaacatggattgtggtatacagattcactaaaacctcgtcactttgtagatagcaagaataatgtatagtctagataacaagaataatgtacatttgttcatgaaattatactgatgaattaagaaccatgaaagcacatacgttaagtttcaatataaataaaactatttgttaaaaatagacatctatttgtaataattagagactaattcatttacaaactgtataagtgcattattgtattattttatttgttgcgtcatgtatcaatataattaattttcttccttcggttgaaaaaatataatcttttattttagcaaagggtttaactaaagaaatataattgctatcaaatataaataaattataatctcattaaactgttcatgttgtctcaagaatataccattaaattttatttgtataaggaaccaaataacacccgtgaaactttacaacttgaaagtaatagtgtactctaagaatgtcaacaaaagttgaaatgtaatataaataaagaaaagacacgaagtcaaacatctatcgaccggtaacagcgtcggcgacaggtgtcatcgccggagacggcaatggagacgaacggcatacgggacacgtaggatgaatcatgagccaagggtcaacgcacttgtcgtggaacaaatggttacaatccggcaaaaccctaatcatatctgtcttcttgtaatccgcgagacatatagaacaacacgacgtcgcagtggcatccttttgcaagctataacccacacgagcctcttcgcacggaaccttagagcatgcgcaacggaggatgaccccgaatccttagcgcttaatggttccattagttttaatataataataatattaagcttaataaacgtaaggattggtccataattaggtgctggacggactcgtcattgtgttacgtgtccgaatttgagtggattcgggccggcttt

SEQ ID NO: 228 - DNA, 1100 bp, Artificial Sequence
  flanking sequence
tatttttgttcatgtcttattttcttttttcctaatgtaactatgagaggcttaaaaactgtaaaatcagcaaaacaatatacaattacagtaaaaaatgtcacatactaagttctatatatgactacaagtctacaactcaactaatcatccacataaataattagttttgtcataattatattatagtaagtacctgaagaaaagataaagccatttctggacaacatcatctcgtattggcatctttatacgtggacgacaaaatctatcacaataatagttgctagatatagatacatgaattttgtaatatgattaattaattggcgcttcataactaaaataactaataaagggtaaatgttcttaaagtttcataattaattatgtttcagagtggttgcattatagtagtttaaaattcagaagtgtacgcgacgagaaaagagatttgctggtgactattgcatcatctttgacatggaaaaaatcttagataagaatagtttgaaattagaaagctcgcaattgaggtctaccaaaattagaaattagaaagctcgcaatccagtcagcatcatcacaccaaaagttaggcccgaatagtttgaaattagaaagctcgcaattgaggtctacaggccaaattcgctcttagccgtacaatattactcaccggtgcgatgccccccatcgtaggtgaaggtggaaattaatggcgcgcctgatcactgattagtaactattacgtaagcctacgtagcgtcacgtgacgttagctaacgctacgtagcctcagctgacgttacgtaagcctacgtagcgtcacgtgagcttagctaacgctacctaggctcagctgacgttacgtaacgctagctagcgtcactcctgcagcaaatttacacattgccactaaacgtctaaacccttgtaatttgtttttgttttactatgtgtgttatgtatttgatttgcgataaatttttatatttggtactaaatttataacaccttttatgctaacgtttgccaacacttagcaatttgcaagttgattaattgattctaaattatttttgtcttctaaatacata

SEQ ID NO: 229 - DNA, 811 bp, Artificial Sequence
  flanking sequence
aatttttctgatttaggattcacatgatccaaaaaggaaatccagaagcactaatcagacattggaagtaggattaatcagtgatcagtaactattaaattcaattaaccgcggacatctacatttttgaattgaaaaaaaattggtaattactctttctttttctccatattgaccatcatactcattgctgatccatgtagatttcccggacatgaagccatttactctgaccctactccacaaatatatttttatttataaaaaggtggccattgtatactatgtgtgcgtatacaggaataaaaatgtgtcaatgtatatgtaaactgattccatcttatatgtaatgtgcgtgtgtaaatgaagatactagtatccatgtgtcgcctacttgatttgttcaactgtaactcataatatctcaagattctttcttttttttctacgaatatcgcaatctataataccattaaattattgtaacaaaattggttgacatttataaaatgaaaaagaagagaagagcatttaaacacgactgatgaaagtccaatgtagctagataaaccacgcgtggtggtcaatgcgttccattccaaaaggatccgagttcgaatccgcaccacaccagattttcactgcgcgtggccatgaagctttcgcattctcgctcctgagaatggttctccattttttttttccagtgtagctagataccggtctgaatctaggtttataatatgctgacaatgtaatgataattaatacatcaaaacatgtgtttctgaaccaaaataaaaactttttt

SEQ ID NO: 230 - DNA, 2900 bp, Artificial Sequence
  flanking sequence
gaaaaacctgcatctccaaaaatgttcaaatggcttaaaaacagagaaaatgagtggaatattagatagatctacctttatagaacacacaaaaatacatatctaaaattattaaatcttcctttaaatgagtggaagatgagaaccatgtgatgaaaaacctgcaaaacaagataaattagtaagaaaaacatgagacagaaacaataaattgatataaagtttgatgtttataagttcaaagggattaaagagaggtttgagagttttagaacgaggaacataccatttttgttgcagccatttgagaggagaagagagaatgtgtaaatgtttttttatataaggagacaaaaattccaataaggttaaatatttttgatcagaagacttactagacgacttacttgtaagtcgcccagaagacttcaatatttttagcgggaaactaaaatatttttagcgggagttagaagaccctaaacataacccttaaactaaattaactaactaaatacttcataaaatcaaattaaacttaaaaagtgtttactatacacagaaataatcacatgtagatataaatttaatttttcaaaaaaacatttaagctttccaaaatctaaccctaagaatacatacaatactacaacatatgttgccaaaccctagaccaaagaatatcatgattcactactttcactcatctatgttgaaaacaattcaattttattatatcttaatttatatcacttaaaactgtttataattacatgattttaattttccgtttatcaaaatattttttacaaaatttataaattatttttaggatcaactataccagacgacttccatggacgccgtacagaagactaaacagaatctcacaagactcagaagacgtagcggggatatattcataaaaatgagttctgtttttttgtttggtcacaaggggctggttgtaatttcacaaggcttttggattacttttgcatttgattcaagtttgggtatacttttgcaatcaaaatcaagttttgagtcatatttggtaaatcgccctatataaaataaaattttaaaaagtaatgaatctacatattttgtaatttttaaaaaatttagttaacaattataataacacaaaacttaagaaaaagttataattgtcgtatttttttctcttttcttttctatgtaatatttttatataagtaataatgtgaatagaatttatcaaatcatatgttagaataattattatataattttatacatttaaaaatttaaatataatcaagatatatacatgtatttatatattaccagatcagagcagatatccgtttcccaaaattttaatatttgtgatttgcttcgattttaatggatattgatttttagtatttttttgcttcaaaagtttatggatattcggaattttcggatcgaatcgaaacgaataacgcatcaaatcaaatttaacggataaaaccttagtaacacatgcataaaccttagtgaacttctcaagctttcgattctctatcttatttatctatgaaattaattaacataattttccttgaattaacataattggactaacgcatattcgagctgaagtcaaaattcccaaaacttgttcttgatatgagtaaaactgttcgtctgatgtaaactcttactgtagttgtattacaaactaatgataaagtatgcattttctattttattataaatttacattactagttgataacatattgacaactagaaagcgtgagagagagatactcggtaagccgagatgtatatccacagttggagtctttggatttcatatccagaattgggtcgcaaactttcagtacaaagttatgacatctccatggtatatatcgacgtgtctatatatcatattaaagaaaggtttgtagtatttggttaggtacaaatgcgatcaacttttgaatttatatccatgtacatatatacccttggttacaaggacacctacccatacatacgcataagtgacaaatagcaaaatatctacacatcgcatgaccccgttcttttttatgataaggttgtgatttttgtggttcttttttttcatctcttacattgattcagtatgttgtccaaaaaaaaaacagtgattcagtattatatcgagtaaattcacaagaacgtagctacaatgtagatgatttattaacaattttacaagagacaagcaaatgtcgagcaatcatattctataatatcaacctaaaagagttaaatccataaaattagttggcaacgagcgatagtatgaaagttaggtgatgacaaaagttgctatattgcttcaactatattttcataaatttatttgtctggatgaaaaccacaaaattttaaaaatataattttgattggtaatatgtaaataacgggatcctatatttaaaccagtcagcatcatcacaccaaaagttaggcccgaatagtttgaaattagaaagctcgcaattgaggtctacaggccaaattcgctcttagccgtacaatattactcaccggtgcgatgccccccatcgtaggtgaaggtggaaattaatggcgcgcctgatcactgattagtaactattacgtaagcctacgtagcgtcacgtgacgttagctaacgctacgtagcctcagctgacgttacgtaagcctacgtagcgtcacgtgagcttagctaacgctacctaggctcagctgacgttacgtaacgctagctagcgtcactcctgcagcaaatttacacattgccactaaacgtctaaacccttgtaatttgtttttgttttactatgtgtgttatgtatttgatttgcgataaatttttatatttggta

SEQ ID NO: 231 - DNA, 1800 bp, Artificial Sequence
  flanking sequence
tttttctgatttaggattcacatgatccaaaaaggaaatccagaagcactaatcagacattggaagtaggattaatcagtgatcagtaactattaaattcaattaaccgcggacatctacatttttgaattgaaaaaaaattggtaattactctttctttttctccatattgaccatcatactcattgctgatccatgtagatttcccggacatgaagccatttacaattgaatatatcctcacatatgaaatatattttttttttacaaattacacctattaaattatacttgatcggtcatctgatatatttgaaagaaccctatcagccagctattcataatttacataaaagaaaattacgtgcttaaaatctctctaaaaaaaaaaaaagacaaagacatcaaactgatccatgaaagtaaaatggagtgtattttaattttatcttcagaccaatgttatcaatgtagcccatatattaatactaaaacaacttctgcacaaacacacgaatcaaagcctcgtgtttcatcgtagctttagctaaaatttcccaaaagcaaattcaatagtattttactaggtcaaacccacaagagaaaaagaaagtcaatcccaaggatcaagaaatgagaagtgagaggagaatgctttattgggtttgctaataactaataagacatgaagcagactgaaaacatctggttttgtccaaaaaagaaggaagtcagattccaaaactgcgcacctacattgtttaatactcactcacacatacattcatgtttttactgtttatacacagtcaataatttatacacagctccatgttttaatatttacccatctctcttttgtagtctatcgtagactttcacttgtgtccccctcatgcggcaacatcctcagcaacttgatttactatatacaataatacaaatcataagatatttgttaggagctggtttgtaaattatttcgatacaatactgaagcgaagggaccagcaatctttttagctgatcagaacaatcttactaacgtgtgtctttgtaagaaaatccaacttttactttttcaggagggagtgtagcggattatgtataaataactcgaagagtggtgcacaaagttcaagtgtttgtgtaaaatgttcgacaagacattgactaaagcattccgaacatgtcaacaaaactacaattctaaaattgcaaaaagctgctaaacggtggaatagcatttaacacgcattctataccaaacattttttttcttgaacaccaaagaaaccaaacctaatgtcaaccatcgtatggaaactatagaactaaatcaaactaacaaattcttattgtatattcttaaaaacatccttataagacagtttttccaaatgaatctttagacttcattgtactaatatgtttaaaataatataattatgtatttaatttcttgaaagtttcgctgctaagaggcaattatctttttatatttttttctctcttattttcaaattctaattaattttcttggagagtttatccgatgatgatattcttatttcaactcaatccacgagtaaatgtgttagcaccacatctaaccatttggagcttgtactagctctatctttccaaacttaactttcttgagtgcttatttatataaagcatcagtatatggcccaacccaagaaaagctgaacaaaattagcaacaatagcaagggacgaactgcagctcttcttggttgtcgtgccttccaattctcgactttccgtggaagaacat

SEQ ID NO: 232 - DNA, 1600 bp, Artificial Sequence
  flanking sequence
gatgaggaagaagtaataaggaaaagaagtttgaagatcagatggtgatggggaaagaggatgatatggcagaagaacttgaagagggtgagatacggagtgtagatgaggagcatgaggctgaagaagatgatgtgaatgagatggttgcttggagcaatgatgaggatgaggaccttggttggcaaacaaatgaacctataaggataaataatgagctcaaggtacctatccttcagcatttcacatttcataatcatagctgttagtggttgagttctttttattgtctctaagcctttgttaactgtttgctaactccaaaccctttttaacttttgcaggagcttcctccagttccacctgtggatgtcactttggaaccacatcatgtcatgcttcctgttggagttgttctttcggtatcataaaataaactctacctgtgcgctattgcttgctaaacctaaaaccattgtgatttctgatgttccaggtactgagcacaccactgacacaagtaatagtggagggaatggaaaagcatagtcctttggccgaaggttctatcctatggataagtgaaagaagaacgccattgggactggtggatgagatctttgcacaagttgagtgcccttactatagtgtgaggttcaattcagaaaacgaagtgccggagggggttagtgaaggtacacctgtctcattcgttgctgagtacgctcagcatattctcaatatcaaggaactgcagaagaaaggttacgatgcatcaggagataacgacgaggaggtagcagaggagcttgagttctcagatgatgagaaagaagcccgaatacataaaaatgcagaagatggaaaagagagggatgatggatgaccaaaaagatggtaacgcaagaaacaagaagaagaaaaacaatgatctcggaacgtctacaagcaatgactcaggggaatggacagagaaccgtgggtttagttctttatcctccaaccgttctgatcctcaaatgggtgatccggtttcgaaccatcagccacgacctcagatggtgggttttcctccaccgtttggaggaaaatgatcaccgaaccgcgccgtgcgcgggtcgtcggtgagccagagtttcagcaggccgcccaggcggcccaggtcgccattgatgcgggccagctcgcggacgtgctcatagtccacgacgcccgtgattttgtagccctggccgacggccagcaggtaggccgacaggctcatgccggccgccgccgccttttcctcaatcgctcttcgttcgtctggaaggcagtacaccttgataggtgggctgcccttcctggttggcttggtttcatcagccatccgcttgccctcatctgttacgccggcggtagccggccagcctcgcagagcaggattcccgttgagcaccgccaggtgcgaataagggacagtgaagaaggaacacccgctcgcgggtgggcctacttcacctatcctgcccggctgacgccgttggatacaccaaggaaagtctacacgaaccctttggcaaaatcctgtatatcgtgcgaaaaaggatggatataccga

SEQ ID NO: 233 - DNA, 3284 bp, Artificial Sequence
  flanking sequence
ccattaatttccaccttcacctacgatggggggcatcgcaccggtgagtaatattgtacggctaagagcgaatttggcctgtagacctcaattgcgagctttctaatttcaaactattcgggcctaacttttggtgtgatgaaagtgtgagaatatttccatattagacaattctgtagattttatttaatgaaagtgtgagaatatttttttgtacactatttatcaatttaataaaaaaatataatataatttaagatgaaccaacatatttctctaaattctgaattttattttcatggtgacacgtggatacgaaacaatgttgtaatgtttatcgattaatatataatgtatgttatatgtttgttgtactaacaacaagatttcatacatttcaaacgaaaaagagagattgatgtgatcagtattattgcttttacaaaactattgaaggttcagcgagttcttagtaaagtcgaatccttgtaataatctctgttccaacgggcaaacatgcagctgttaaactatcgacgccgtttgacctattttttcttcttctttgttttcttcctcatttgtacatgcgtgcaagcctactgacggttggatgccttggcacgcacttcaacaactctatatccttcctggtgaggctatgtacgcttttaagcttcttttcttggacgcccttgagcttcttgcttggaggtgggagggtgagaagattagccctcttgctagagctttgttcgctcctgctgttgcttgtaagcttggattctgggctagattcgttgctctccctctctggcttcaacctactgttcacactgctttgtgtatctgtgctactgtgtgtactggtagcttctacctcgccttcttcttctttatctctcacaacttcgacggtgttggtagcgttggacctaagggatcacttcctagatcagctactttcgttcaacgtcaggttgagactagctctaacgttggtggttactggcttggagttcttaacggtggacttaactttcagatagagcaccacttgttccctaggcttcaccactcttactacgctcaaatagctcagtaaaatcaactgtgtccacattatcagttttgtgtatacgatgaaatagggtaattcaaaatctagcttgatatgccttttggttcattttaaccttctgtaaacattttttcagattttgaacaagtaaatccaaaaaaaaaaaaaaaaatctcaactcaacactaaattattttaatgtataaaagatgcttaaaacatttggcttaaaagaaagaagctaaaaacatagagaactcttgtaaattgaagtatgaaaatatactgaattgggtattatatgaatttttctgatttaggattcacatgatccaaaaaggaaatccagaagcactaatcagacattggaagtaggattaatcagtgatcagtaactattaaattcaattaaccgcggacatctacatttttgaattgaaaaaaaattggtaattactctttctttttctccatattgaccatcatactcattgctgatccatgtagatttcccggacatgaagccatcagtttccaatgaaccctcagttccagatgctgaacaacaacaggccacagtctccaatgaacccacatttccaaatgcaaccgcagtttcctatgaaccctcagttccaaatgctgaacaataacaggccacagtctcaagggtttaacgctgggaagtcttctgagcggggaaaggggccaccatggtcgtggcagagatagttgtaggggtcggtttggacgtgggcgagggcaacagtgtggatgaaactgtatctgtgaagcattttgatgtgtgtgaaaagcatgttttatttggttttgtatgccaaatttttgtggtaaattaaattaactcagttatgattaataatgaacgccgttgccgagatcgaacccgggtcacccgcgtgacaggcgggaatacttgccactatactacaacgactttgttgttaacacaatttacaagtctaaacaaacctttaagtagctgttatatttggtttaaaaggcgggaacttacgtaattagtggctttcctttgaagcaaacacccaaaaaggtccatcatctccatgtcatcctcgtacgcttcgaactacactaaactgatcactctcactaaacagttaagctcttacgcgaaccaaggaaaccatgagcaagctctcaacctctttcgccaaatgcaatcttctttcgccttacctctcgacgcacacgtcttctcactcgccctcaaatcctgcgctgcagccttccgtcctgccctcggcgaatccatccatgcccacaccctcaaatctaactttctctcaaacccattcgtgggatccgctctactcgatatgtatggtaaatgcgtctctgtttctcacgctcgcaaactgttcgacgaaattccccagaggaacgctgttgtctggaacgcgatgatttcgcattacacgcatcgtggaaacatcagggaagctgtcgagttgtatgaggcgatggatgttatgccaaatgagtcttctttcaatgctatcataaagggtttagtgagtacagaggatgggtcttataaagcaattggattctataggaagatggttgagtttagattcaagcctactttgattactcttcttgcgctagtatcagcttgttctgtcatcggggcgtttcggttggtaaaagagattcattcatatgcttttaggaatctgattgagccgcacccgcagttgaaaagcgggttggtagaggcgtatgggaggtgcggaagcattgattacgtgcaattggtgtttgagagcatggttgatagggatgtggttgcttggagtagcttggtgtctgcttatgcgcttcacggtgacgctgaatccgccctcagagcatttcaagaaatggaatctgctaaagtacgacctgatgacatagcgtttctgaacgtgctgaaggcctgtagtcacgctgggttagctgatgaggctattggttactttaagaggatgcaggatggttacggtttgagtgcaagcaaggaccattactcgtgtttggtggatgttttaagcagagtggggaggtttgaagaagcttacaaagtgattcaagctatgcctgagaagccaacggctaagacatggggggctctgcttggagcgtgtaggaactacggggaggttgagcttgcggagat

SEQ ID NO: 234 - DNA, 1700 bp, Artificial Sequence
  flanking sequence
attgatgtgatcagtattattgcttttacaaaactattgaaggttcagcgagttcttagtaaagtcgaatccttgtaataatctctgttccaacgggcaaacatgcagctgttaaactatcgacgccgtttgacctattttttcttcttctttgttttcttcctcatttgtattactattttataagttttgtgtagcgttgtaaagctttgacgctacgtagcgttacctaaggtcacgtgagtctaggtaggcttagctaatctcaggtgacgctacgtagccttacctaacgtcaggtgaggctagctagcgttagctaacctcacctgacgctacgtagcgttacgtaacgtcacgtgagcctaggtagccttacgtaacgtcaggtgacgctacgtagacaatcagtaaattgaacggagaatattattcataaaaatacgatagtaacgggtgatatattcattagaatgaaccgaaaccggcggtaaggatctgagctacacatgctcaggttttttacaacgtgcacaacagaattgaaagcaaatatcatgcgatcataggcgtctcgcatatctcattaaagcagcaatcaattattcattaatcactactcagccttaccacccttctcagcaccaggtctagttcccatcttacccatatgctgaagcattgagctaaggttagatccaacggtagggaagtgacggtacttaaaaccgagcttctctatgtgagtcctaaccacaggagctatttgagcgtagtaagagtggtgaagcctagggaacaagtggtgctctatctgaaagttaagtccaccgttaagaactccaagccagtaaccaccaacgttagagctagtctcaacctgacgttgaacgaaagtagctgatctaggaagtgatcccttaggtccaacgctaccaacaccgtcgaagttgtgagagataaagaagaagaaggcgaggtagaagctaccagtacacacagtagcacagatacacaaagcagtgtgaacagtaggttgaagccagagagggagagcaacgaatctagcccagaatccaagcttacaagcaacagcaggagcgaacaaagctctagcaagagggctaatcttctcaccctcccacctccaagcaagaagctcaagggcgtccaagaaaagaagcttaaaagcgtacatagcctcaccaggaaggatatagagttgttgaagtgcgtgccaaggcatccaaccgtcagtaggctattctgtagattttatttaatgaaagtgtgagaatatttagacaattctgtagattttatttaatgaaagtgtgagaatatttttttaaggcccgaatagtttgaaattagaaagctcgcaattgaggtctacaggccaaattcgctcttagccgtacaatattactcaccggtgcgatgccccccatcgtaggtgaaggtggaaattaatggcgcgcctgatcactgattagtaactattacgtaagcctacgtagcgtcacgtgacgttagctaacgctacgtagcctcagctgacgttacgtaagcctacgtagcgtcacgtgagcttagctaacgctacctaggctcagctgacgttacgtaacgctagctagcgtcactcctgcagcaaatttacacattgccactaaacgtctaaacccttgtaatttgtt

SEQ ID NO: 235 - DNA, 1532 bp, Artificial Sequence
  flanking sequence
gtggtaaggctgagtagtgattaatgaataattgattgctgctttaatgagatatgcgagacgcctatgatcgcatgatatttgctttcaattctgttgtgcacgttgtaaaaaacctgagcatgtgtagctcagatccttaccgccggtttcggttcattctaatgaatatatcacccgttactatcgtatttttatgaataatattctccgttcaatttactgattgtctacgtagcgtcacctgacgttacgtaaggctacctaggctcacgtgacgttacgtaacgctacgtagcgtcaggtgaggttagctaacgctagctagcctcacctgacgttaggtaaggctacgtagcgtcacctgagattagctaagcctacctagactcacgtgaccttaggtaacgctacgtagcgtcaaagctttacaacgctacacaaaactgcttgcgtttcttctctcattacgagaatatacttttttcaatattgcttcaaaaactttctgtcatgtgaatttgattttagatatatgtttaaaaaatacttcctccccgaaaataagattttctaaagtgttcgattattaagaattcattaaatatttataatttaatttttcttttactttattatacattttctaataactttttaccaataaaatttaatcaattcaaatatttttatttaatgtttcttaaaagtataaaaaatatcttaatcatatagaaaatatatttttgtggaacaagtaaaaatctaaaacatcttactttcaggaacggaggtaatagatagttacattaaaggtctcaacattactattttaagtctattcacttgttttgcttgcttgctaaccaaacaaagtttactagtttaattaatatattaataaaaatatccaatatatgaccttgaccaagacaaatgtgctagagtagtattaacggcgtcagttgccgttaatcccatttaccaaaatatatatactacaagggaatctcttctctctctctcaccattcaatcatttccatctttttcaaaatctccttttcccactctctctctctctcgcttgaagaacaagattggtatatttgttacaacgggctagtttatcaatatctttcacaaataaagaagaagaaggtgatatctttgaggttgatatctcgaagaaaatggggaagaaagagcagaaagatcatcattcaacagtagaaagcgacgacaaagtcgaagctgttcttcatctccttcgtaaacattctcctctcactcttaaacaggtttgtttacgaattaattatctcactgatctttcattaatctatcagctttttttttttgaagtgctggttttttatattctcgggttaataaatattgcaggagaagttctgtaacagagcttgtgtcagtagattcttgagaacaaaaggagacaatgcgaagaaagcagctaaacagttaaggtcatgcctttcatggagatcttctcttggcatcggtatactcttc

SEQ ID NO: 236 - DNA, 1200 bp, Artificial Sequence
  flanking sequence
gtgacgttacgtaacgctacgtagcgtcaggtgaggttagctaacgctagctagcctcacctgacgttaggtaaggctacgtagcgtcacctgagattagctaagcctacctagactcacgtgaccttaggtaacgctacgtagcgtcaaagctttacaacgctacacaaaaatgcttgcgtttcttctctcattacgagaatatacttttttcaatattgcttcaaaaactttctgtcatgtgaatttgattttagatatatgtttaaaaaatacttcctccccgaaaataagattttctaaagtgttcgattattaagaattcattaaatatttataatttaatttttcttttactttattatacattttctaataactttttaccaataaaatttaatcaattcaaatatttttatttaatgtttcttaaaagtataaaaaatatcttaatcatatagaaaatatatttttgtggaacaagtaaaaatctaaaacatcttactttcaggaacggaggtaatagatagttacattaaaggtctcaacattactattttaagtctattcacttgttttgcttgcttgctaaccaaacaaagtttactagtttaattaatatattaataaaaatatccaatatatgaccttgaccaagacaaatgtgctagagtagtattaacggcgtcagttgccgttaatcccatttaccaaaatatatatactacaagggaatctcttctctctctctcaccattcaatcatttccatctttttcaaaatctccttttcccactctctctctctctcgcttgaagaacaagattggtatatttgttacaacgggctagtttatcaatatctttcacaaataaagaagaagaaggtgatatctttgaggttgatatctcgaagaaaatggggaagaaagagcagaaagatcatcattcaacagtagaaagcgacgacaaagtcgaagctgttcttcatctccttcgtaaacattctcctctcactcttaaacaggtttgtttacgaattaattatctcactgatctttcattaatctatcagctttttttttttgaagtgctggttttttatattctcgggttaataaatattgcaggagaagttctgtaacagagcttgtgtcagtagattcttgagaacaaaaggagacaatgcgaagaaagcagc

SEQ ID NO: 237 - DNA, 1600 bp, Artificial Sequence
  flanking sequence
aaaagaaatataaaagaatatgaccaaaaaagtaaacgtgagtgagagaataagaaaatgactacaaaatataatagcctcaattatcttcaaaactaagttgacatttaattatgcttttgcaagatatttacttttgttgttcgatcatatttaatgattattttggttttgaaacaaatattaacattatatatattgtgtctatattgaactgttgtaaattataaacatcaaaattttaatgttatcttaattataatttctaatactagtatattcaaaaatcaaaataaacatattttataaaatagtgccagtacgtagtatgggagataatactagtggctttataaagggaaacattgtctctaaaatctcagataaaatgttaaaacacacttattcacaattatgaagatttgaaatatctgaaatttcaaattgatgcacttggtagaaagcaaaggttcaacgctaagtctacaaggtgtaataatgaagtgaaaatgctagtttagattacccttgatatgtgactgaacatagggtggagcgtcagtgagtccatggagtacagaagctaaacaagagacatggttaagcaccagaatcaactcgttctccatagagtccagcttttgagatatatgtgaatagccttgttgcaatatacttgtgagtggcaggcgtgatcttattaacgaaagtccaaattctgaacaaagtttatatcaagctacgatggaaatatggaatccgtatcaaaatcaactgtactgtatcatacggtgcagatttttagctcgactctaccaccttgcgtttacttttgtgatgaacattgcgattatatatgaggacctaaatagagggaaaatgtatgaagacaggatcctaagaatgaaaaaccagcatccccaagatgtggcaccaagtgctatcgaccacaaactacgctggacatactctgatatagttcgttaagaaatcaaaatgtcaacacatataaataagcagtcagcatcatcacaccaaaagttaggcccgaatagtttgaaattagaaagctcgcaattgaggtctacaggccaaattcgctcttagccgtacaatattactcaccggtgcgatgccccccatcgtaggtgaaggtggaaattaatggcgcgcctgatcactgattagtaactattacgtaagcctacgtagcgtcacgtgacgttagctaacgctacgtagcctcagctgacgttacgtaagcctacgtagcgtcacgtgagcttagctaacgctacctaggctcagctgacgttacgtaacgctagctagcgtcactcctgcagcaaatttacacattgccactaaacgtctaaacccttgtaatttgtttttgttttactatgtgtgttatgtatttgatttgcgataaatttttatatttggtactaaatttataacaccttttatgctaacgtttgccaacacttagcaatttgcaagttgattaattgattctaaattatttttgtcttctaaatacatatactaatcaactggaaatgtaaatatttgctaatatttctactataggagaatt

SEQ ID NO: 238 - DNA, 1677 bp, Artificial Sequence
  flanking sequence
taattgaaattcgttattagggttctaagctgttttaacagtcactgggttaatatctctcgaatcttgcatggaaaatgctcttaccattggtttttaattgaaatgtgctcatatgggccgtggtttccaaattaaataaaactacgatgtcatcgagaagtaaaatcaactgtgtccacattatcagttttgtgtatacgatgaaatagggtaattcaaaatctagcttgatatgccttttggttcattttaaccttctgtaaacattttttcagattttgaacaagtaaatccaaaaaaaaaaaaaaaaatctcaactcaacactaaattattttaatgtataaaagatgcttaaaacatttggcttaaaagaaagaagctaaaaacatagagaactcttgtaaattgaagtatgaaaatatactgaattgggtattatatgaatttttctgatttaggattcacatgatccaaaaaggaaatccagaagcactaatcagacattggaagtaggattaatcagtgatcagtaactattaaattcaattaaccgcggacatctacatttttgaattgaaaaaaaattggtaattactctttctttttctccatattgaccatcatactcattgtaagacacacagatgaagaagtcaaatagctcgacattcctttggtctggtccagtgatgtcgactcacaaagcgaagattgcatgaatagactatcatgtgtttgctatgtatgagtactatggaatcgagggatcatttatttttcatgtcattgttcttggaggttgtgtggagaggcatcaccattaatcttctgaacatcagctatactaatcattaattggaatcagcgactgcaaattatggcagaggatgttggaaatagtaccaccacattcctaatccactatgctttccaagctgcagtaatttgagttggagacgggagttttgctcatttactcaggctcttggacaaacaaatgtgaaatcgcatatctgctcaatccgacatactaatcaaaggtcaagaattttttttagagaagatgaaaaccataatgaaagcatctaatgtttatagaaaattaccaaaaataccacatttatgaaaaattatcaaaaatacaatattcatagtatcacttttcatatttacaataaccacgtttgttctcaattttaacgaagaacaaacgacatttataatcctaagataattttttctaattcaaaaataattttcgattttcaaaaaaaaaattgaaaaaaaaattgaaaagaaaaattcaaaacaaaattatatgaaagttcaaatttgaaaaatgataattcaaaaacataaaaaaatatatttttatttaaataattatttattatatatatatagaccatggagcaagggggcgtgggccccggggcccaaactttttttcccatatataatgtcaacaaggacccgatttttagaaaaaaaaataggtataaaggagtccaaaaaattcaaattagttatatatgtatgtaaaaaaatattaaaatttattttgcccaagggcctatagattcattgggccgaccctggggttggggttgtgtgtgtgtcattctataattaaccggcaaaaactccaaaatttttatttaacaaatgtataa

SEQ ID NO: 239 - DNA, 5600 bp, Artificial Sequence
  flanking sequence
attttagatttagtcatatttttaacttaattattaattataataaatatttttagtgatttagatgataaattttcattgtcttgagaataataaaaaaaaaatctaaggataatatcatagttaaatttatatgatatttacttcagtaatattaaaatattatatacatttttattatatttggtttagtaatattaaatggattctattttaaatttcttatgacaatcaaaaccacttagtgtgataatttctgaaaaaaattggcaaaaaaatcaaaaatacttatcttattatttgtagtgatttttctctctctcatgttaaaattttgaatgtttaaagtctttattatctttaataaataattagattaaatttttaatatataattacccataatttaaaacaaatttcattaattttaaaatcatcattatctaaaaagattatatattatgttatccaaaaatattttacatcataatattttaaaataaatataaatttatgtatattgttttatgtatatatgaatgtttttaagtttattttacataatcaaatatattttacaaaaataatttttatcatatataaaatttaacatttaattaattattaaatatttcaaaagtatgaatataacttattctcatggtttttaattgataatatatctatttacaattttttgtaaaattattaaacccgcaagtatggacaaaacacctagtatatatatttggaacaaagaatacagacaaaacacctagtatatatatttggaacaaaaaatatacgtacatattttatatacatgaataacttatatatcacttagaaataggataatcaattgacattaaactctcttaaattatatattgtatagaactatagatatacgtataaaatatttataaaagataactacactatatatagaaacagataatgatacatccacgaaaattcttctggaaaagaaacagagtggtttcgcgtcagcacacctacgttgatcattggaaattggaatattgaaacacgcttcaaatcaacgactattaattaccaatacaccctggctttggggtgagagttgatcggttaattatccaatacatgccgttggttaattaggattatataaaaaatcgatcatctattagaatcgattacggttaaataggtataaaaatggagagaattgaatcagttataaatttgttttcagttaaaatatttctatgatcttcaatcgatttcggtattttatactcaacatggaaaaaatttcaaatgtatttcttctaaaagcaaaagaatctataaaaactatcattttatccaaaacaccaaaatagtcttttacaatcttttacagccttcacataaacgaaaacaaaagtgaacaatttctttttacagcctttacaccaaaaagactacgatgaactatgataaaatttcataatctaaaaacattaatgaggtaaagactctctcaaatgggatattcttcgaaaattttcataatcgaacgatatacttgaatttgcaactcatgaccgaaattgtcccaatccataatactctttgacaccctatcagatcccaacgttgtccctggtttcgaaaccaccatttcaaacatgaacatatcacaaaataaacatttagacaccaaatatctgctaagcgcttacgtaagctcagctgacgctacctagcgttagctaacgtcacgtgacgctacctagcgttacgtaacgtcagctgaggctagctagctgaattaacgccgaattaattcgggggatctggattttagtactggattttggttttaggaattagaaattttattgatagaagtattttacaaatacaaatacatactaagggtttcttatatgctcaacacatgagcgaaaccctataggaaccctaattcccttatctgggaactactcacacattattatggagaaactcgagcttgtcgatcactcggtcttagctcccttttgctttccatcggatggcttgatgtacttttgcacgtagaagtttccgaagaggaacaagagggagatcatgtagtagaagaggatcttgatgagccattgtggatatggagcgttggttttcatatcgtagtaagcttgcaccaagttgagcatgaactggaacatctggaattgggtgaggtatcttccccagaagaggtacttgttcttgagctttggggaagatctcaagcaagcagccaagaagtagtaagcgtacatcaacacgtgcactccagagttgagagcagcactccaataagcctctcctcctggagcgtggtgagcaatagcccaccagataagggagatagaagagtggtggtacacgtggaggaaagaaatctgtctggtggatctcttgaggatcatgatcacggtatccatgaactccacgtacttggacatgtagaagaggtaaacgaggatagccatctccttgtgctttgggttataagcgtttccccacaaggaatatctccaggtgatagcttggtaagcgatacccacgcacatgtaaagagacaaagcgaagcagaacaagttgtgcaccaacaccaaagcttgcaacaagaatggctcagaagctcttggcttgagatctctagccttgatccaaagcaatcctccgatcacgatggtcaagtaaacagacactcccaacacaattggagttggagaatcaacgagtggcaatcccttagtagttggggtatcagtcaactcaactccgaaagatcccaacaaagcgttcactccttgggaaacctttccatccaactctccgtagaacctctcaacaacttccatggtttcttctaaagctgaaagtgaaccattattacaacttaacactcaactcacaagaggagaagcaacaaagcttatgtaaggatttagtattaaggccaaaaaaacacagatcaaattcaattattgaagctttacttatcaagttatcatataaccaatgaagacggtaattcaaaagaaaaataaaagggtttgtagaataattgatacgtttacctttgccgattcagagacagtgaagcttaaacagtactggctatgaagaaattataatcgtgtaaaacttagtgagtgtgtatgaatgaaagtattgcaaaatcctcattatatagactacatgcataactagttgcatgtaaatttgtagttttcttcattattgcatcctccaagtggatgtcatggttttacacatggcttccatgcaaatcatttccaaaatatttttaaactttccacagggcatccatgcatgcacctcaaaacttgtgtgtggtaacattgttgtcttgaaaaattactaaaccttttgtccacgtgacgttcatgcacctcaaatcttgtgtggtaccattattatcctcaagaattattgaatgtttggtgtatatgccatccatgcagcattgcaacaattaaatctccaaaccttgtggtaccatattcactcactttaattctcctatagtagaaatattagcaaatatttacatttccagttgattagtatatgtatttagaagacaaaaataatttagaatcaattaatcaacttgcaaattgctaagtgttggcaaacgttagcataaaaggtgttataaatttagtaccaaatataaaaatttatcgcaaatcaaatacataacacacatagtaaaacaaaaacaaattacaagggtttagacgtttagtggcaatgtgtaaatttgctgcaggagtgacgctagctagcgttacgtaacgtcagctgagcctaggtagcgttagctaagctcacgtgacgctacgtaggcttacgtaacgtcagctgaggctacgtagcgttagctaacgtcacgtgacgctacgtaggcttacgtaatagttactaatcagtgatcaggcgcgccattaatttccaccttcacctacgatggggggcatcgcaccggtgagtaatattgtacggctaagagcgaatttggcctgtagacctcaattgcgagctttctaatttcaaactattcgggcctaacttttggtgtgatgatgctgactgtttcgacgttaattgatcctacactatgtaggtcatatccatcgttttaatttttggccaccattcaattctgtcttgcctttagggatgtgaatatgaacggccaaggtaagagaataaaaataatccaaattaaagcaagagaggccaagtaagataatccaaatgtacacttgtcattgccaaaattagtaaaatactcggcatattgtattcccacacattattaaaataccgtatatgtattggctgcatttgcatgaataatactacgtgtaagcccaaaagaacccacgtgtagcccatgcaaagttaacactcacgaccccattcctcagtctccactatataaacccaccatccccaatctcaccaaacccaccacacaactcacaactcactctcacaccttaaagaaccaatcaccaccaaaaaatttcacgatttggaatttgattcctgcgatcacaggtatgacaggttagattttgttttgtatagttgtatacatacttctttgtgatgttttgtttacttaatcgaatttttggagtgttttaaggtctctcgtttagaaatcgtggaaaatatcactgtgtgtgtgttcttatgattcacagtgtttatgggtttcatgttctttgttttatcattgaatgggaagaaatttcgttgggatacaaatttctcatgttcttactgatcgttattaggagtttggggaaaaaggaagagtttttttggttggttcgagtgattatgaggttatttctgtatttgatttatgagttaatggtcgttttaatgttgtagacatgggaaaaggatctgagggaagatctgctgctagagagatgactgctgaggctaacggagataagagaaagaccatcctcattgagggagtgttgtacgatgctaccaacttcaaacacccaggaggttccattattaacttcctcaccgagggagaagctggagttgatgctacccaagcttacagagagttccatcagagatccggaaaggctgataagtacctcaagtccctcccaaagttggatgcttctaaggtggagtctaggttctctgctaaggagcaggctagaagggacgctatgaccagggattacgctgctttcagagaggagttggttgctgagggatacttcgatccatctatcccacacatgatctacagagtggtggagattgtggctttgttcgctttgtctttctggttgatgtctaaggcttctccaacctctttggttttgggagtggtgatgaacggaatcgctcaaggaagatgcggatgggttatgcacgagatgggacacggatctttcactggagttatctggctcgatgataggatgtgcgagttcttctacggagttggatgtggaatgtctggacactactggaagaaccagcactctaagcaccac

SEQ ID NO: 240 - DNA, 1321 bp, Artificial Sequence
  flanking sequence
taaagatatattaggcaatgagtttatgatgttatgtttatatagtttatttcattttaaattgaaaagcattatttttatcgaaatgaatctagtatacaatcaatatttatgttttttcatcagatactttcctattttttggcacctttcatcggactactgatttatttcaatgtgtatgcatgcatgagcatgagtatacacatgtcttttaaaatgcatgtaaagcgtaacggaccacaaaagaggatccatacaaatacatctcatcgcttcctctactattctccgacacacacactgagcatggtgcttaaacactctggtgagttctagtacttctgctataatgttaaattttatattatatacctacttcctctctctcgctctgttatgttcgatttcgaaaggatttcaagatcaaagatgatgagaaaaggtaccttttcgatatttaagacaaggaaagaaaggacgaggttgaaattttcgggacttggagggctaaagtggaagagactgaatctgaagatgtcgtttctcgaaactttgagatacagaatcatgtctatcattgaaggaatggttttggtttctaagcttgctttcttctttctctgttgcggttgcagattttaacacgttagttttttttttttcgtttttttgaacgtcaacaatgtcttttttgtactctttagctcatgtgtaaaattctaaattcttccaataacatacccaacaaattattcgtatctgatttttatagtttttaacctgttaatgtaattaatctaagtgtaatttttaggctaaatgttaaattttatattaaagttttgtaacttgaaattacattcttcttatagcggataaacagaaaatgctcttaaacaaatcctgaaacaagtaaaaaatacaacagaaaaatctaacgtttaattcttaaaacctcaaaatccttatttttacagctttcaaagtttaacagctggaaacctgtagaaaatcagacacagcctctcaagttttctggacaataaatactggtaacgtaagaaaaccaattaatgataccgtcgttcagtagatagaactgacgatgtgaagattaattgtttctgtaatatactgaatttgaaaatttatcatcatcatgttaacggaagttgtctgtaaaagtagttgattacctgttatcgtgtaaagtagttagtaatttcttgcttatttgaaaaatagagaacatttaacatgtatttttaaataggcacgaccatgctactgaactttatgaaatgctttggaatcttat

SEQ ID NO: 241 - DNA, 100 bp, Artificial Sequence
  amplicon
aagacgtccgcaatgtgttattaagttgtctaagcgtcaatttgttgtcggcaagatctctgacactcaactaaaatgttggattttccctttcaggtgt

SEQ ID NO: 242 - DNA, 148 bp, Artificial Sequence
  amplicon
cacacacctccccaatccatggatatgttctctcttttctcaatcaatttgtttacactcaaacactgatagtttaaactgaaggcgggaaacgacaatctgatcactgattagtaactaaggcctttaattaatctagaggcgcgcc

SEQ ID NO: 243 - DNA, 147 bp, Artificial Sequence
  amplicon
ggcgcgcctctagattaattaaaggccttagttactaatcagtgatcagattgtcgtttcccgccttcagtttaaactatcagtgttgctttagtggtcaatcaaaagatgaacagtatcttctcgatcgatgatttctccgatccc

SEQ ID NO: 244 - DNA, 118 bp, Artificial Sequence
  amplicon
caccaaaagcaaccaagagagacgtctttaatgtactgaatttagtaactgaaggcgggaaacgacaatctgatcactgattagtaactaaggcctttaattaatctagaggcgcgcc

SEQ ID NO: 245 - DNA, 110 bp, Artificial Sequence
  amplicon
gcggacatctacatttttgaattgaaaaaaaattggtaattactctttctttttctccatattgaccatcatactcattgtaagacacacagatgaagaagtcaaatagc

SEQ ID NO: 246 - DNA, 95 bp, Artificial Sequence
  amplicon
cactgagcatggtgcttaaacactctggtgagttctagtacttctgctataatgttaaattttatattatatacctacttcctctctctcgctct

SEQ ID NO: 247 - DNA, 101 bp, Artificial Sequence
  amplicon
ctctttctttttctccatattgaccatcatactcattgctgatccatgtagatttcccggacatgaagccatttgtcaacgtcgttgtttgatttcgttaa

SEQ ID NO: 248 - DNA, 197 bp, Artificial Sequence
  amplicon
caattaaccgcggacatctacatttttttactgctattctttcatattagcaactggttgattactgaattagtacagatgtaactaacatatatattggatattattattatccaaaagagctattcaaccttttaagcatatgtatatacatgtttaattgattttattagtatttcttgctcttgttgttttgc

SEQ ID NO: 249 - DNA, 138 bp, Artificial Sequence
  amplicon
aattaaccgcggacatctacatttttgaattgaaaaaaaattggtaattactctttctttttctccatattgaccatcatactcattgctgatccatgtagatttcccggttctttttctcagactactcactgcccg

SEQ ID NO: 250 - DNA, 137 bp, Artificial Sequence
  amplicon
ctctttctttttctccatattgaccatcatactcattgctgatccatgtagatttcccggacatgaagccatttacaatccatgtccttataaatggtttatatactcttataaataatttgcttcttcatgcctca

SEQ ID NO: 251 - DNA, 113 bp, Artificial Sequence
  amplicon
ctctttctttttctccatattgaccatcatactcattgctgatccatgtagatttcccggacatgaagccatttacaatgagtcaaaaaaaagttgttttgatgagtcactgc

SEQ ID NO: 252 - DNA, 160 bp, Artificial Sequence
  amplicon
ctctttctttttctccatattgaccatcatactcattgctgatccatgtagatttcccggacatgaagccatttactctgaccctactccacaaatatatttttatttataaaaaggtggccattgtatactatgtgtgcgtatacaggaataaaaatgt

SEQ ID NO: 253 - DNA, 169 bp, Artificial Sequence
  amplicon
ccatattgaccatcatactcattgctgatccatgtagatttcccggacatgaagccatttacaattgaatatatcctcacatatgaaatatattttttttttacaaattacacctattaaattatacttgatcggtcatctgatatatttgaaagaaccctatcagcca

SEQ ID NO: 254 - DNA, 576 bp, Artificial Sequence
  amplicon
gacctcaattgcgagctttctaatttcaaactattcgggcctaacttttggtgtgatgaaagtgtgagaatatttccatattagacaattctgtagattttatttaatgaaagtgtgagaatatttttttgtacactatttatcaatttaataaaaaaatataatataatttaagatgaaccaacatatttctctaaattctgaattttattttcatggtgacacgtggatacgaaacaatgttgtaatgtttatcgattaatatataatgtatgttatatgtttgttgtactaacaacaagatttcatacatttcaaacgaaaaagagagattgatgtgatcagtattattgcttttacaaaactattgaaggttcagcgagttcttagtaaagtcgaatccttgtaataatctctgttccaacgggcaaacatgcagctgttaaactatcgacgccgtttgacctattttttcttcttctttgttttcttcctcatttgtacatgcgtgcaagcctactgacggttggatgccttggcacgcacttcaacaactctatatccttcctggtgagg

SEQ ID NO: 255 - DNA, 189 bp, Artificial Sequence
  amplicon
cgtgccaaggcatccaaccgtcagtaggctattctgtagattttatttaatgaaagtgtgagaatatttagacaattctgtagattttatttaatgaaagtgtgagaatatttttttaaggcccgaatagtttgaaattagaaagctcgcaattgaggtctacaggccaaattcgctcttagccgtaca

SEQ ID NO: 256 - DNA, 91 bp, Artificial Sequence
  amplicon
gcctacctagactcacgtgaccttaggtaacgctacgtagcgtcaaagctttacaacgctacacaaaaatgcttgcgtttcttctctcatt

SEQ ID NO: 257 - DNA, 873 bp, Artificial Sequence
  d6Elo(Pp) as by plasmid VC-LTM593-1qcz
atggaagttgttgagaggttctacggagagttggatggaaaggtttcccaaggagtgaacgctttgttgggatctttcggagttgagttgactgataccccaactactaagggattgccactcgttgattctccaactccaattgtgttgggagtgtctgtttacttgaccatcgtgatcggaggattgctttggatcaaggctagagatctcaagccaagagcttctgagccattcttgttgcaagctttggtgttggtgcacaacttgttctgcttcgctttgtctctttacatgtgcgtgggtatcgcttaccaagctatcacctggagatattccttgtggggaaacgcttataacccaaagcacaaggagatggctatcctcgtttacctcttctacatgtccaagtacgtggagttcatggataccgtgatcatgatcctcaagagatccaccagacagatttctttcctccacgtgtaccaccactcttctatctcccttatctggtgggctattgctcaccacgctccaggaggagaggcttattggagtgctgctctcaactctggagtgcacgtgttgatgtacgcttactacttcttggctgcttgcttgagatcttccccaaagctcaagaacaagtacctcttctggggaagatacctcacccaattccagatgttccagttcatgctcaacttggtgcaagcttactacgatatgaaaaccaacgctccatatccacaatggctcatcaagatcctcttctactacatgatctccctcttgttcctcttcggaaacttctacgtgcaaaagtacatcaagccatccgatggaaagcaaaagggagctaagaccgagtga

SEQ ID NO: 258 - protein, 290 aa, Physcomitrella patens
  MISC_FEATURE: d6Elo(Pp) as by plasmid VC-LTM593-1qcz
MEVVERFYGELDGKVSQGVNALLGSFGVELTDTPTTKGLPLVDSPTPIVLGVSVYLTIVIGGLLWIKARDLKPRASEPFLLQALVLVHNLFCFALSLYMCVGIAYQAITWRYSLWGNAYNPKHKEMAILVYLFYMSKYVEFMDTVIMILKRSTRQISFLHVYHHSSISLIWWAIAHHAPGGEAYWSAALNSGVHVLMYAYYFLAACLRSSPKLKNKYLFWGRYLTQFQMFQFMLNLVQAYYDMKTNAPYPQWLIKILFYYMISLLFLFGNFYVQKYIKPSDGKQKGAKTE

SEQ ID NO: 259 - DNA, 1320 bp, Artificial Sequence
  d5Des(Tc) as by plasmid VC-LTM593-1qcz
atgggaaaaggatctgagggaagatctgctgctagagagatgactgctgaggctaacggagataagagaaagaccatcctcattgagggagtgttgtacgatgctaccaacttcaaacacccaggaggttccattattaacttcctcaccgagggagaagctggagttgatgctacccaagcttacagagagttccatcagagatccggaaaggctgataagtacctcaagtccctcccaaagttggatgcttctaaggtggagtctaggttctctgctaaggagcaggctagaagggacgctatgaccagggattacgctgctttcagagaggagttggttgctgagggatacttcgatccatctatcccacacatgatctacagagtggtggagattgtggctttgttcgctttgtctttctggttgatgtctaaggcttctccaacctctttggttttgggagtggtgatgaacggaatcgctcaaggaagatgcggatgggttatgcacgagatgggacacggatctttcactggagttatctggctcgatgataggatgtgcgagttcttctacggagttggatgtggaatgtctggacactactggaagaaccagcactctaagcaccacgctgctccaaacagattggagcacgatgtggatttgaacaccttgccactcgttgctttcaacgagagagttgtgaggaaggttaagccaggatctttgttggctttgtggctcagagttcaggcttatttgttcgctccagtgtcttgcttgttgatcggattgggatggaccttgtacttgcacccaagatatatgctcaggaccaagagacacatggagtttgtgtggatcttcgctagatatatcggatggttctccttgatgggagctttgggatattctcctggaacttctgtgggaatgtacctctgctctttcggacttggatgcatctacatcttcctccaattcgctgtgtctcacacccacttgccagttaccaacccagaggatcaattgcactggcttgagtacgctgctgatcacaccgtgaacatctctaccaagtcttggttggttacctggtggatgtctaacctcaacttccaaatcgagcaccacttgttcccaaccgctccacaattcaggttcaaggagatctctccaagagttgaggctctcttcaagagacacaacctcccttactacgatttgccatacacctctgctgtttctactaccttcgctaacctctactctgttggacactctgttggagctgataccaagaagcaggattga

SEQ ID NO: 260 - protein, 439 aa, Thraustochytrium sp.
  MISC_FEATURE: d5Des(Tc) as by plasmid VC-LTM593-1qcz
MGKGSEGRSAAREMTAEANGDKRKTILIEGVLYDATNFKHPGGSIINFLTEGEAGVDATQAYREFHQRSGKADKYLKSLPKLDASKVESRFSAKEQARRDAMTRDYAAFREELVAEGYFDPSIPHMIYRVVEIVALFALSFWLMSKASPTSLVLGVVMNGIAQGRCGWVMHEMGHGSFTGVIWLDDRMCEFFYGVGCGMSGHYWKNQHSKHHAAPNRLEHDVDLNTLPLVAFNERVVRKVKPGSLLALWLRVQAYLFAPVSCLLIGLGWTLYLHPRYMLRTKRHMEFVWIFARYIGWFSLMGALGYSPGTSVGMYLCSFGLGCIYIFLQFAVSHTHLPVTNPEDQLHWLEYAADHTVNISTKSWLVTWWMSNLNFQIEHHLFPTAPQFRFKEISPRVEALFKRHNLPYYDLPYTSAVSTTFANLYSVGHSVGADTKKQD

SEQ ID NO: 261 - DNA, 1371 bp, Artificial Sequence
  d6Des(Ot) as by plasmid VC-LTM593-1qcz
atgtgtgttgagaccgagaacaacgatggaatccctactgtggagatcgctttcgatggagagagagaaagagctgaggctaacgtgaagttgtctgctgagaagatggaacctgctgctttggctaagaccttcgctagaagatacgtggttatcgagggagttgagtacgatgtgaccgatttcaaacatcctggaggaaccgtgattttctacgctctctctaacactggagctgatgctactgaggctttcaaggagttccaccacagatctagaaaggctaggaaggctttggctgctttgccttctagacctgctaagaccgctaaagtggatgatgctgagatgctccaggatttcgctaagtggagaaaggagttggagagggacggattcttcaagccttctcctgctcatgttgcttacagattcgctgagttggctgctatgtacgctttgggaacctacttgatgtacgctagatacgttgtgtcctctgtgttggtttacgcttgcttcttcggagctagatgtggatgggttcaacacgagggaggacactcttctttgaccggaaacatctggtgggataagagaatccaagctttcactgctggattcggattggctggatctggagatatgtggaactccatgcacaacaagcaccacgctactcctcaaaaagtgaggcacgatatggatttggataccactcctgctgttgctttcttcaacaccgctgtggaggataatagacctaggggattctctaagtactggctcagattgcaagcttggaccttcattcctgtgacttctggattggtgttgctcttctggatgttcttcctccacccttctaaggctttgaagggaggaaagtacgaggagcttgtgtggatgttggctgctcacgtgattagaacctggaccattaaggctgttactggattcaccgctatgcaatcctacggactcttcttggctacttcttgggtttccggatgctacttgttcgctcacttctctacttctcacacccacttggatgttgttcctgctgatgagcacttgtcttgggttaggtacgctgtggatcacaccattgatatcgatccttctcagggatgggttaactggttgatgggatacttgaactgccaagtgattcaccacctcttcccttctatgcctcaattcagacaacctgaggtgtccagaagattcgttgctttcgctaagaagtggaacctcaactacaaggtgatgacttatgctggagcttggaaggctactttgggaaacctcgataatgtgggaaagcactactacgtgcacggacaacactctggaaagaccgcttga

SEQ ID NO: 262 - protein, 456 aa, Ostreococcus tauri
  MISC_FEATURE: d6Des(Ot) as by plasmid VC-LTM593-1qcz
MCVETENNDGIPTVEIAFDGERERAEANVKLSAEKMEPAALAKTFARRYVVIEGVEYDVTDFKHPGGTVIFYALSNTGADATEAFKEFHHRSRKARKALAALPSRPAKTAKVDDAEMLQDFAKWRKELERDGFFKPSPAHVAYRFAELAAMYALGTYLMYARYVVSSVLVYACFFGARCGWVQHEGGHSSLTGNIWWDKRIQAFTAGFGLAGSGDMWNSMHNKHHATPQKVRHDMDLDTTPAVAFFNTAVEDNRPRGFSKYWLRLQAWTFIPVTSGLVLLFWMFFLHPSKALKGGKYEELVWMLAAHVIRTWTIKAVTGFTAMQSYGLFLATSWVSGCYLFAHFSTSHTHLDVVPADEHLSWVRYAVDHTIDIDPSQGWVNWLMGYLNCQVIHHLFPSMPQFRQPEVSRRFVAFAKKWNLNYKVMTYAGAWKATLGNLDNVGKHYYVHGQHSGKTA

SEQ ID NO: 263 - DNA, 819 bp, Artificial Sequence
  d6Elo(Tp) as by plasmid VC-LTM593-1qcz
atggatgcttataacgctgctatggataagattggagctgctatcatcgattggagtgatccagatggaaagttcagagctgatagggaggattggtggttgtgcgatttcagatccgctatcaccattgctctcatctacatcgctttcgtgatcttgggatctgctgtgatgcaatctctcccagctatggacccataccctatcaagttcctctacaacgtgtctcaaatcttcctctgcgcttacatgactgttgaggctggattcctcgcttataggaacggatacaccgttatgccatgcaaccacttcaacgtgaacgatccaccagttgctaacttgctctggctcttctacatctccaaagtgtgggatttctgggataccatcttcattgtgctcggaaagaagtggagacaactctctttcttgcacgtgtaccaccacaccaccatcttcctcttctactggttgaacgctaacgtgctctacgatggagatatcttcttgaccatcctcctcaacggattcattcacaccgtgatgtacacctactacttcatctgcatgcacaccaaggattctaagaccggaaagtctttgccaatctggtggaagtcatctttgaccgctttccaactcttgcaattcaccatcatgatgtcccaagctacctacttggttttccacggatgcgataaggtttccctcagaatcaccatcgtgtacttcgtgtacattctctcccttttcttcctcttcgctcagttcttcgtgcaatcctacatggctccaaagaagaagaagtccgcttga

SEQ ID NO: 264 - protein, 272 aa, Thalassiosira pseudonana
  MISC_FEATURE: d6Elo(Tp) as by plasmid VC-LTM593-1qcz
MDAYNAAMDKIGAAIIDWSDPDGKFRADREDWWLCDFRSAITIALIYIAFVILGSAVMQSLPAMDPYPIKFLYNVSQIFLCAYMTVEAGFLAYRNGYTVMPCNHFNVNDPPVANLLWLFYISKVWDFWDTIFIVLGKKWRQLSFLHVYHHTTIFLFYWLNANVLYDGDIFLTILLNGFIHTVMYTYYFICMHTKDSKTGKSLPIWWKSSLTAFQLLQFTIMMSQATYLVFHGCDKVSLRITIVYFVYILSLFFLFAQFFVQSYMAPKKKKSA

SEQ ID NO: 265 - DNA, 1197 bp, Artificial Sequence
  d12Des(Ps) as by plasmid VC-LTM593-1qcz
atggctattttgaaccctgaggctgattctgctgctaacctcgctactgattctgaggctaagcaaagacaattggctgaggctggatacactcacgttgagggtgctcctgctcctttgcctttggagttgcctcacttctctctcagagatctcagagctgctattcctaagcactgcttcgagagatctttcgtgacctccacctactacatgatcaagaacgtgttgacttgcgctgctttgttctacgctgctaccttcattgatagagctggagctgctgcttatgttttgtggcctgtgtactggttcttccagggatcttacttgactggagtgtgggttatcgctcacgagtgtggacaccaggcttattgctcttctgaggtggtgaacaacttgattggactcgtgttgcactctgctttgttggtgccttaccactcttggagaatctctcacagaaagcaccactccaacactggatcttgcgagaacgatgaggttttcgttcctgtgaccagatctgtgttggcttcttcttggaacgagaccttggaggattctcctctctaccaactctaccgtatcgtgtacatgttggttgttggatggatgcctggatacctcttcttcaacgctactggacctactaagtactggggaaagtctaggtctcacttcaacccttactccgctatctatgctgatagggagaggtggatgatcgtgctctccgatattttcttggtggctatgttggctgttttggctgctttggtgcacactttctccttcaacacgatggtgaagttctacgtggtgccttacttcattgtgaacgcttacttggtgttgattacctacctccaacacaccgatacctacatccctcacttcagagagggagagtggaattggttgagaggagctttgtgcactgtggatagatcatttggtccattcctcgattctgtggtgcatagaatcgtggatacccacgtttgccaccatatcttctccaagatgcctttctatcactgcgaggaggctaccaacgctattaagcctctcctcggaaagttctacttgaaggatactactcctgttcctgttgctctctggagatcttacacccactgcaagttcgttgaggatgatggaaaggtggtgttctacaagaacaagttatag

SEQ ID NO: 266 - protein, 398 aa, Phytophthora sojae
  MISC_FEATURE: d12Des(Ps) as by plasmid VC-LTM593-1qcz
MAILNPEADSAANLATDSEAKQRQLAEAGYTHVEGAPAPLPLELPHFSLRDLRAAIPKHCFERSFVTSTYYMIKNVLTCAALFYAATFIDRAGAAAYVLWPVYWFFQGSYLTGVWVIAHECGHQAYCSSEVVNNLIGLVLHSALLVPYHSWRISHRKHHSNTGSCENDEVFVPVTRSVLASSWNETLEDSPLYQLYRIVYMLVVGWMPGYLFFNATGPTKYWGKSRSHFNPYSAIYADRERWMIVLSDIFLVAMLAVLAALVHTFSFNTMVKFYVVPYFIVNAYLVLITYLQHTDTYIPHFREGEWNWLRGALCTVDRSFGPFLDSVVHRIVDTHVCHHIFSKMPFYHCEEATNAIKPLLGKFYLKDTTPVPVALWRSYTHCKFVEDDGKVVFYKNKL

SEQ ID NO: 267 - DNA, 1092 bp, Artificial Sequence
  o3Des(Pir) as by plasmid VC-LTM593-1qcz
atggcttctacatctgctgctcaagacgctgctccttacgagttcccttctctcactgagatcaagagggctcttccttctgagtgtttcgaggcttctgttcctctttctctctactacaccgctagatctcttgctcttgctggatctctcgctgttgctctctcttacgctagagctttgcctcttgttcaggctaacgctcttcttgatgctactctctgcactggatacgttcttctccagggaatcgttttctggggattcttcaccgttggtcacgattgtggacacggagctttctctagatctcacgtgctcaacttctctgttggaaccctcatgcactctatcatccttacccctttcgagtcttggaagctctctcacagacaccaccacaagaacaccggaaacatcgataaggacgagatcttctaccctcaaagagaggctgattctcaccctgtttctagacaccttgtgatgtctcttggatctgcttggttcgcttaccttttcgctggattccctcctagaaccatgaaccacttcaacccttgggaggctatgtatgttagaagagtggctgctgtgatcatctctctcggagttcttttcgctttcgctggactctactcttacctcaccttcgttcttggattcaccactatggctatctactacttcggacctctcttcatcttcgctaccatgcttgttgttaccactttcctccaccacaacgatgaggagacaccttggtacgctgattctgagtggacttacgtgaagggaaacctctcttctgtggacagatcttacggtgctctcatcgacaaccttagccacaacatcggaactcaccagatccaccacctcttccctatcatccctcactacaagctcaacgatgctactgctgctttcgctaaggctttccctgagcttgttaggaaaaacgctgctcctatcatcccaactttcttcaggatggctgctatgtacgctaagtacggagttgttgacactgatgctaagaccttcactctcaaggaggctaaggctgctgctaagactaagtcatcttga

SEQ ID NO: 268 - protein, 363 aa, Pythium irregulare
  MISC_FEATURE: o3Des(Pir) as by plasmid VC-LTM593-1qcz
MASTSAAQDAAPYEFPSLTEIKRALPSECFEASVPLSLYYTARSLALAGSLAVALSYARALPLVQANALLDATLCTGYVLLQGIVFWGFFTVGHDCGHGAFSRSHVLNFSVGTLMHSIILTPFESWKLSHRHHHKNTGNIDKDEIFYPQREADSHPVSRHLVMSLGSAWFAYLFAGFPPRTMNHFNPWEAMYVRRVAAVIISLGVLFAFAGLYSYLTFVLGFTTMAIYYFGPLFIFATMLVVTTFLHHNDEETPWYADSEWTYVKGNLSSVDRSYGALIDNLSHNIGTHQIHHLFPIIPHYKLNDATAAFAKAFPELVRKNAAPIIPTFFRMAAMYAKYGVVDTDAKTFTLKEAKAAAKTKSS

SEQ ID NO: 269 - DNA, 1086 bp, Artificial Sequence
  o3Des(Pi) as by plasmid VC-LTM593-1qcz
atggctacaaaggaggcttacgttttcccaactctcaccgagatcaagagatctctcccaaaggattgcttcgaggcttctgtgcctttgtctctctactacactgtgagatgcttggttattgctgtggctttgaccttcggattgaactacgctagagctttgccagaggttgagtctttctgggctttggatgctgctttgtgcactggatatatcctcctccagggaattgtgttctggggattcttcactgttggacacgatgctggacacggagctttctctagataccacctcttgaacttcgttgtgggaaccttcatgcactctctcatcttgaccccattcgagtcttggaagttgacccacagacaccaccacaagaacaccggaaacatcgatagagatgaggtgttctacccacagagaaaggctgatgatcacccattgtccaggaacttgatcttggctttgggagctgcttggcttgcttatttggtggagggattcccaccaagaaaggtgaaccacttcaacccattcgagccactttttgtgagacaagtgtccgctgtggttatctctttgctcgctcacttcttcgttgctggactctctatctacttgtctctccagttgggacttaagaccatggctatctactactacggaccagttttcgtgttcggatctatgttggtgattaccaccttcttgcaccacaacgatgaggagactccatggtatgctgattctgagtggacttacgtgaagggaaacttgtcctctgtggatagatcttacggtgctctcatcgataacctctcccacaacatcggaactcaccagatccaccacctcttcccaattatcccacactacaagctcaagaaggctactgctgctttccaccaagctttcccagagcttgtgagaaagtccgatgagccaatcatcaaggctttcttcagagtgggaaggttgtatgctaactacggagtggttgatcaagaggctaagctcttcactttgaaggaggctaaggctgctactgaagctgctgctaagaccaagtctacctga

SEQ ID NO: 270 - protein, 361 aa, Phytophthora infestans
  MISC_FEATURE: o3Des(Pi) as by plasmid VC-LTM593-1qcz
MATKEAYVFPTLTEIKRSLPKDCFEASVPLSLYYTVRCLVIAVALTFGLNYARALPEVESFWALDAALCTGYILLQGIVFWGFFTVGHDAGHGAFSRYHLLNFVVGTFMHSLILTPFESWKLTHRHHHKNTGNIDRDEVFYPQRKADDHPLSRNLILALGAAWLAYLVEGFPPRKVNHFNPFEPLFVRQVSAVVISLLAHFFVAGLSIYLSLQLGLKTMAIYYYGPVFVFGSMLVITTFLHHNDEETPWYADSEWTYVKGNLSSVDRSYGALIDNLSHNIGTHQIHHLFPIIPHYKLKKATAAFHQAFPELVRKSDEPIIKAFFRVGRLYANYGVVDQEAKLFTLKEAKAATEAAAKTKST

SEQ ID NO: 271 - DNA, 1560 bp, Artificial Sequence
  d4Des(Tc) as by plasmid VC-LTM593-1qcz
atgactgttggatacgacgaggagatcccattcgagcaagttagggctcataacaagccagacgacgcttggtgtgctattcacggacacgtgtacgacgttaccaagttcgcttcagttcacccaggaggagatattatcttgctcgctgctggaaaggaagctactgtcctctacgagacctaccatgttagaggagtgtctgacgctgtgctcagaaagtacagaataggaaagttgccagacggacaaggaggagctaacgagaaggagaagagaaccttgtctggattgtcctctgcttcttactacacctggaactccgatttctacagagtgatgagggagagagttgtggctagattgaaggagagaggaaaggctagaagaggaggatacgaactctggatcaaggctttcttgctccttgttggattctggtcctctctttactggatgtgcaccctcgatccatctttcggagctatcttggctgctatgtctttgggagtgttcgctgcttttgttggaacctgcatccaacacgatggaaaccacggagctttcgctcaatctagatgggttaacaaggtggcaggatggactttggatatgatcggagcttctggaatgacttgggagttccaacacgtgttgggacaccacccatacactaacttgatcgaggaggagaacggattgcaaaaggtgtccggaaagaagatggataccaagttggctgatcaagagtctgatccagatgtgttctccacctacccaatgatgagattgcacccttggcaccagaagaggtggtatcacaggttccagcacatctacggacctttcatcttcggattcatgaccatcaacaaggtggtgactcaagatgttggagtggtgttgagaaagagactcttccaaatcgatgctgagtgcagatatgcttccccaatgtacgttgctaggttctggattatgaaggctttgaccgtgttgtatatggttgctttgccttgttatatgcaaggaccttggcacggattgaaactcttcgctatcgctcacttcacttgcggagaggttttggctaccatgttcatcgtgaaccacattatcgagggagtgtcttacgcttctaaggatgctgttaagggaactatggctccaccaaagactatgcacggagtgaccccaatgaacaacactagaaaggaggttgaggctgaggcttctaagtctggagctgtggttaagtctgtgccattggatgattgggctgctgttcagtgccaaacctctgtgaactggtctgttggatcttggttttggaaccacttctctggaggactcaaccaccaaatcgagcaccacctcttcccaggattgtctcacgagacctactaccacatccaagacgtggttcaatctacctgtgctgagtacggagttccataccaacacgagccatctttgtggactgcttactggaagatgctcgaacaccttagacaattgggaaacgaggagactcacgagtcatggcagagagctgcttga

SEQ ID NO: 272 - protein, 519 aa, Thraustochytrium sp.
  MISC_FEATURE: d4Des(Tc) as by plasmid VC-LTM593-1qcz
MTVGYDEEIPFEQVRAHNKPDDAWCAIHGHVYDVTKFASVHPGGDIILLAAGKEATVLYETYHVRGVSDAVLRKYRIGKLPDGQGGANEKEKRTLSGLSSASYYTWNSDFYRVMRERVVARLKERGKARRGGYELWIKAFLLLVGFWSSLYWMCTLDPSFGAILAAMSLGVFAAFVGTCIQHDGNHGAFAQSRWVNKVAGWTLDMIGASGMTWEFQHVLGHHPYTNLIEEENGLQKVSGKKMDTKLADQESDPDVFSTYPMMRLHPWHQKRWYHRFQHIYGPFIFGFMTINKVVTQDVGVVLRKRLFQIDAECRYASPMYVARFWIMKALTVLYMVALPCYMQGPWHGLKLFAIAHFTCGEVLATMFIVNHIIEGVSYASKDAVKGTMAPPKTMHGVTPMNNTRKEVEAEASKSGAVVKSVPLDDWAAVQCQTSVNWSVGSWFWNHFSGGLNHQIEHHLFPGLSHETYYHIQDVVQSTCAEYGVPYQHEPSLWTAYWKMLEHLRQLGNEETHESWQRAA

SEQ ID NO: 273 - DNA, 1338 bp, Artificial Sequence
  d4Des(Pl) as by plasmid VC-LTM593-1qcz
atgccacctagtgctgctagtgaaggtggtgttgctgaacttagagctgctgaagttgctagctacactagaaaggctgttgacgaaagacctgacctcactatagttggtgacgctgtttacgacgctaaggcttttagggacgagcaccctggtggtgctcacttcgttagccttttcggaggtagggacgctactgaggcttttatggaatatcaccgtagagcttggcctaaggctaggatgtctaagttcttcgttggttcacttgacgctagcgagaagcctactcaagctgattcagcttaccttagactttgcgctgaggttaacgctcttttgcctaagggtagcggaggattcgctcctcctagctactggcttaaggctgctgctcttgttgttgctgctgttagtatagagggttatatgctccttaggggtaagacccttttgcttagcgttttccttggactcgtgttcgcttggataggacttaatattcagcacgacgctaatcacggtgctcttagtagacactcagtgattaactactgcctcggttacgctcaggattggataggtggtaatatggtgctttggcttcaagagcacgttgtgatgcaccacctccacactaacgacgttgacgctgatcctgatcaaaaggctcacggtgttcttagacttaagcctactgacggttggatgccttggcacgcacttcaacaactctatatccttcctggtgaggctatgtacgcttttaagcttcttttcttggacgcccttgagcttcttgcttggaggtgggagggtgagaagattagccctcttgctagagctttgttcgctcctgctgttgcttgtaagcttggattctgggctagattcgttgctctccctctctggcttcaacctactgttcacactgctttgtgtatctgtgctactgtgtgtactggtagcttctacctcgccttcttcttctttatctctcacaacttcgacggtgttggtagcgttggacctaagggatcacttcctagatcagctactttcgttcaacgtcaggttgagactagctctaacgttggtggttactggcttggagttcttaacggtggacttaactttcagatagagcaccacttgttccctaggcttcaccactcttactacgctcaaatagctcctgtggttaggactcacatagagaagctcggttttaagtaccgtcacttccctaccgttggatctaaccttagctcaatgcttcagcatatgggtaagatgggaactagacctggtgctgagaagggtggtaaggctgagtag

SEQ ID NO: 274 - protein, 445 aa, Pavlova lutheri
  MISC_FEATURE: d4Des(Tc) as by plasmid VC-LTM593-1qcz
MPPSAASEGGVAELRAAEVASYTRKAVDERPDLTIVGDAVYDAKAFRDEHPGGAHFVSLFGGRDATEAFMEYHRRAWPKARMSKFFVGSLDASEKPTQADSAYLRLCAEVNALLPKGSGGFAPPSYWLKAAALVVAAVSIEGYMLLRGKTLLLSVFLGLVFAWIGLNIQHDANHGALSRHSVINYCLGYAQDWIGGNMVLWLQEHVVMHHLHTNDVDADPDQKAHGVLRLKPTDGWMPWHALQQLYILPGEAMYAFKLLFLDALELLAWRWEGEKISPLARALFAPAVACKLGFWARFVALPLWLQPTVHTALCICATVCTGSFYLAFFFFISHNFDGVGSVGPKGSLPRSATFVQRQVETSSNVGGYWLGVLNGGLNFQIEHHLFPRLHHSYYAQIAPVVRTHIEKLGFKYRHFPTVGSNLSSMLQHMGKMGTRPGAEKGGKAE

SEQ ID NO: 275 - DNA, 903 bp, Artificial Sequence
  d5Elo(Ot) as by plasmid VC-LTM593-1qcz
atgtctgctagcggagctttgttgcctgctatagctttcgctgcttacgcttacgctacctacgcttatgctttcgagtggagccacgctaacggaatcgataacgtggatgctagagagtggattggagctttgtctttgagactccctgcaattgcaaccacaatgtacctcttgttctgccttgtgggacctagattgatggctaagagggaggcttttgatcctaagggatttatgctcgcttacaacgcttaccaaaccgctttcaacgttgtggtgctcggaatgttcgctagagagatctctggattgggacaacctgtttggggatctactatgccttggagcgataggaagtccttcaagattttgttgggagtgtggctccactacaacaataagtacctcgagttgttggatactgtgttcatggtggctaggaaaaagaccaagcagctctctttcttgcacgtgtaccaccacgctttgttgatttgggcttggtggcttgtttgtcacctcatggctaccaacgattgcatcgatgcttatttcggagctgcttgcaactctttcatccacatcgtgatgtactcctactacctcatgtctgctttgggaattaggtgcccttggaagagatatatcacccaggctcagatgttgcaattcgtgatcgtgttcgctcacgctgttttcgtgctcagacaaaagcactgccctgttactttgccttgggcacaaatgttcgtgatgacaaatatgttggtgctcttcggaaacttctacctcaaggcttactctaacaagtctaggggagatggagcttcttctgttaagcctgctgagactactagagcaccttctgtgagaagaaccaggtcaaggaagatcgattga

SEQ ID NO: 276 - protein, 300 aa, Ostreococcus tauri
  MISC_FEATURE: d5Elo(Ot) as by plasmid VC-LTM593-1qcz
MSASGALLPAIAFAAYAYATYAYAFEWSHANGIDNVDAREWIGALSLRLPAIATTMYLLFCLVGPRLMAKREAFDPKGFMLAYNAYQTAFNVVVLGMFAREISGLGQPVWGSTMPWSDRKSFKILLGVWLHYNNKYLELLDTVFMVARKKTKQLSFLHVYHHALLIWAWWLVCHLMATNDCIDAYFGAACNSFIHIVMYSYYLMSALGIRCPWKRYITQAQMLQFVIVFAHAVFVLRQKHCPVTLPWAQMFVMTNMLVLFGNFYLKAYSNKSRGDGASSVKPAETTRAPSVRRTRSRKID

SEQ ID NO: 277 - DNA, 2013 bp, Artificial Sequence
  AHAS as by plasmid VC-LTM593-1qcz
atggcggcggcaacaacaacaacaacaacatcttcttcgatctccttctccaccaaaccatctccttcctcctccaaatcaccattaccaatctccagattctccctcccattctccctaaaccccaacaaatcatcctcctcctcccgccgccgcggtatcaaatccagctctccctcctccatctccgccgtgctcaacacaaccaccaatgtcacaaccactccctctccaaccaaacctaccaaacccgaaacattcatctcccgattcgctccagatcaaccccgcaaaggcgctgatatcctcgtcgaggctttagaacgtcaaggcgtagaaaccgtattcgcttaccctggaggtacatcaatggagattcaccaagccttaacccgctcttcctcaatccgtaacgtccttcctcgtcacgaacaaggaggtgtattcgcagcagaaggatacgctcgatcctcaggtaaaccaggtatctgtatagccacttcaggtcccggagctacaaatctcgttagcggattagccgatgcgttgttagatagtgttcctcttgtagcaatcacaggacaagtccctcgtcgtatgattggtacagatgcgtttcaagagactccgattgttgaggtaacgcgttcgattacgaagcataactatcttgtgatggatgttgaagatatcccaaggattattgaagaggctttctttttagctacttctggtagacctggacctgttttggttgatgttcctaaagatattcaacaacagcttgcgattcctaattgggaacaggctatgagattacctggttatatgtctaggatgcctaaacctccggaagattctcatttggagcagattgttaggttgatttctgagtctaagaagcctgtgttgtatgttggtggtggttgtcttaattctagcgatgaattgggtaggtttgttgagcttacgggcatccctgttgcgagtacgttgatggggctgggatcttatccttgtgatgatgagttgtcgttacatatgcttggaatgcatgggactgtgtatgcaaattacgctgtggagcatagtgatttgttgttggcgtttggggtaaggtttgatgatcgtgtcacgggtaaacttgaggcttttgctagtagggctaagattgttcatattgatattgactcggctgagattgggaagaataagactcctcatgtgtctgtgtgtggtgatgttaagctggctttgcaagggatgaataaggttcttgagaaccgagcggaggagcttaaacttgattttggagtttggaggaatgagttgaacgtacagaaacagaagtttccgttgagctttaagacgtttggggaagctattcctccacagtatgcgattaaggtccttgatgagttgactgatggaaaagccataataagtactggtgtcgggcaacatcaaatgtgggcggcgcagttctacaattacaagaaaccaaggcagtggctatcatcaggaggccttggagctatgggatttggacttcctgctgcgattggagcgtctgttgctaaccctgatgcgatagttgtggatattgacggagatggaagttttataatgaatgtgcaagagctagccactattcgtgtagagaatcttccagtgaaggtacttttattaaacaaccagcatcttggcatggttatgcaatgggaagatcggttctacaaagctaaccgagctcacacatttctcggggacccggctcaggaggacgagatattcccgaacatgttgctgtttgcagcagcttgcgggattccagcggcgagggtgacaaagaaagcagatctccgagaagctattcagacaatgctggatacaccaggaccttacctgttggatgtgatttgtccgcaccaagaacatgtgttgccgatgatcccgaatggtggcactttcaacgatgtcataacggaaggagatggccggattaaatactga

SEQ ID NO: 278 - protein, 670 aa, Arabidopsis thaliana
  MISC_FEATURE: AHAS as by plasmid VC-LTM593-1qcz
MAAATTTTTTSSSISFSTKPSPSSSKSPLPISRFSLPFSLNPNKSSSSSRRRGIKSSSPSSISAVLNTTTNVTTTPSPTKPTKPETFISRFAPDQPRKGADILVEALERQGVETVFAYPGGTSMEIHQALTRSSSIRNVLPRHEQGGVFAAEGYARSSGKPGICIATSGPGATNLVSGLADALLDSVPLVAITGQVPRRMIGTDAFQETPIVEVTRSITKHNYLVMDVEDIPRIIEEAFFLATSGRPGPVLVDVPKDIQQQLAIPNWEQAMRLPGYMSRMPKPPEDSHLEQIVRLISESKKPVLYVGGGCLNSSDELGRFVELTGIPVASTLMGLGSYPCDDELSLHMLGMHGTVYANYAVEHSDLLLAFGVRFDDRVTGKLEAFASRAKIVHIDIDSAEIGKNKTPHVSVCGDVKLALQGMNKVLENRAEELKLDFGVWRNELNVQKQKFPLSFKTFGEAIPPQYAIKVLDELTDGKAIISTGVGQHQMWAAQFYNYKKPRQWLSSGGLGAMGFGLPAAIGASVANPDAIVVDIDGDGSFIMNVQELATIRVENLPVKVLLLNNQHLGMVMQWEDRFYKANRAHTFLGDPAQEDEIFPNMLLFAAACGIPAARVTKKADLREAIQTMLDTPGPYLLDVICPHQEHVLPMIPNGGTFNDVITEGDGRIKY

SEQ ID NO: 279 - DNA, 60074 bp, Artificial Sequence; identical to SEQ ID NO: 3
  vector VC-LTM593-1qcz rc

SEQ ID NO: 280 - DNA, 44910 bp, Artificial Sequence
  contig of insert and flanking sequences of LBFLFK T-DNA Locus 1
tatttttgttcatgtcttattttcttttttcctaatgtaactatgagaggcttaaaaactgtaaaatcagcaaaacaatatacaattacagtaaaaaatgtcacatactaagttctatatatgactacaagtctacaactcaactaatcatccacataaataattagttttgtcataattatattatagtaagtacctgaagaaaagataaagccatttctggacaacatcatctcgtattggcatctttatacgtggacgacaaaatctatcacaataatagttgctagatatagatacatgaattttgtaatatgattaattaattggcgcttcataactaaaataactaataaagggtaaatgttcttaaagtttcataattaattatgtttcagagtggttgcattatagtagtttaaaattcagaagtgtacgcgacgagaaaagagatttgctggtgactattgcatcatctttgacatggaaaaaatcttagataagaatagtttgaaattagaaagctcgcaattgaggtctaccaaaattagaaattagaaagctcgcaatccagtcagcatcatcacaccaaaagttaggcccgaatagtttgaaattagaaagctcgcaattgaggtctacaggccaaattcgctcttagccgtacaatattactcaccggtgcgatgccccccatcgtaggtgaaggtggaaattaatggcgcgcctgatcactgattagtaactattacgtaagcctacgtagcgtcacgtgacgttagctaacgctacgtagcctcagctgacgttacgtaagcctacgtagcgtcacgtgagcttagctaacgctacctaggctcagctgacgttacgtaacgctagctagcgtcactcctgcagcaaatttacacattgccactaaacgtctaaacccttgtaatttgtttttgttttactatgtgtgttatgtatttgatttgcgataaatttttatatttggtactaaatttataacaccttttatgctaacgtttgccaacacttagcaatttgcaagttgattaattgattctaaattatttttgtcttctaaatacatatactaatcaactggaaatgtaaatatttgctaatatttctactataggagaattaaagtgagtgaatatggtaccacaaggtttggagatttaattgttgcaatgctgcatggatggcatatacaccaaacattcaataattcttgaggataataatggtaccacacaagatttgaggtgcatgaacgtcacgtggacaaaaggtttagtaatttttcaagacaacaatgttaccacacacaagttttgaggtgcatgcatggatgccctgtggaaagtttaaaaatattttggaaatgatttgcatggaagccatgtgtaaaaccatgacatccacttggaggatgcaataatgaagaaaactacaaatttacatgcaactagttatgcatgtagtctatataatgaggattttgcaatactttcattcatacacactcactaagttttacacgattataatttcttcatagccagtactgtttaagcttcactgtctctgaatcggcaaaggtaaacgtatcaattattctacaaacccttttatttttcttttgaattaccgtcttcattggttatatgataacttgataagtaaagcttcaataattgaatttgatctgtgtttttttggccttaatactaaatccttacataagctttgttgcttctcctcttgtgagttgagtgttaagttgtaataatggttcactttcagctttagaagaaaccatggaagttgttgagaggttctacggagagttggatggaaaggtttcccaaggagtgaacgctttgttgggatctttcggagttgagttgactgataccccaactactaagggattgccactcgttgattctccaactccaattgtgttgggagtgtctgtttacttgaccatcgtgatcggaggattgctttggatcaaggctagagatctcaagccaagagcttctgagccattcttgttgcaagctttggtgttggtgcacaacttgttctgcttcgctttgtctctttacatgtgcgtgggtatcgcttaccaagctatcacctggagatattccttgtggggaaacgcttataacccaaagcacaaggagatggctatcctcgtttacctcttctacatgtccaagtacgtggagttcatggataccgtgatcatgatcctcaagagatccaccagacagatttctttcctccacgtgtaccaccactcttctatctcccttatctggtgggctattgctcaccacgctccaggaggagaggcttattggagtgctgctctcaactctggagtgcacgtgttgatgtacgcttactacttcttggctgcttgcttgagatcttccccaaagctcaagaacaagtacctcttctggggaagatacctcacccaattccagatgttccagttcatgctcaacttggtgcaagcttactacgatatgaaaaccaacgctccatatccacaatggctcatcaagatcctcttctactacatgatctccctcttgttcctcttcggaaacttctacgtgcaaaagtacatcaagccatccgatggaaagcaaaagggagctaagaccgagtgatcgacaagctcgagtttctccataataatgtgtgagtagttcccagataagggaattagggttcctatagggtttcgctcatgtgttgagcatataagaaacccttagtatgtatttgtatttgtaaaatacttctatcaataaaatttctaattcctaaaaccaaaatccagtactaaaatccagatcccccgaattaattcggcgttaattcagctagctagcctcagctgacgttacgtaacgctaggtagcgtcacgtgacgttagctaacgctaggtagcgtcagctgagcttacgtaagcgcttagcagatatttggtgtctaaatgtttattttgtgatatgttcatgtttgaaatggtggtttcgaaaccagggacaacgttgggatctgatagggtgtcaaagagtattatggattgggacaatttcggtcatgagttgcaaattcaagtatatcgttcgattatgaaaattttcgaagaatatcccatttgagagagtctttacctcattaatgtttttagattatgaaattttatcatagttcatcgtagtctttttggtgtaaaggctgtaaaaagaaattgttcacttttgttttcgtttatgtgaaggctgtaaaagattgtaaaagactattttggtgttttggataaaatgatagtttttatagattcttttgcttttagaagaaatacatttgaaattttttccatgttgagtataaaataccgaaatcgattgaagatcatagaaatattttaactgaaaacaaatttataactgattcaattctctccatttttatacctatttaaccgtaatcgattctaatagatgatcgattttttatataatcctaattaaccaacggcatgtattggataattaaccgatcaactctcacccctaatagaatcagtattttccttcgacgttaattgatcctacactatgtaggtcatatccatcgttttaatttttggccaccattcaattctgtcttgcctttagggatgtgaatatgaacggccaaggtaagagaataaaaataatccaaattaaagcaagagaggccaagtaagataatccaaatgtacacttgtcattgccaaaattagtaaaatactcggcatattgtattcccacacattattaaaataccgtatatgtattggctgcatttgcatgaataatactacgtgtaagcccaaaagaacccacgtgtagcccatgcaaagttaacactcacgaccccattcctcagtctccactatataaacccaccatccccaatctcaccaaacccaccacacaactcacaactcactctcacaccttaaagaaccaatcaccaccaaaaaatttcacgatttggaatttgattcctgcgatcacaggtatgacaggttagattttgttttgtatagttgtatacatacttctttgtgatgttttgtttacttaatcgaatttttggagtgttttaaggtctctcgtttagaaatcgtggaaaatatcactgtgtgtgtgttcttatgattcacagtgtttatgggtttcatgttctttgttttatcattgaatgggaagaaatttcgttgggatacaaatttctcatgttcttactgatcgttattaggagtttggggaaaaaggaagagtttttttggttggttcgagtgattatgaggttatttctgtatttgatttatgagttaatggtcgttttaatgttgtagaccatgggaaaaggatctgagggaagatctgctgctagagagatgactgctgaggctaacggagataagagaaagaccatcctcattgagggagtgttgtacgatgctaccaacttcaaacacccaggaggttccattattaacttcctcaccgagggagaagctggagttgatgctacccaagcttacagagagttccatcagagatccggaaaggctgataagtacctcaagtccctcccaaagttggatgcttctaaggtggagtctaggttctctgctaaggagcaggctagaagggacgctatgaccagggattacgctgctttcagagaggagttggttgctgagggatacttcgatccatctatcccacacatgatctacagagtggtggagattgtggctttgttcgctttgtctttctggttgatgtctaaggcttctccaacctctttggttttgggagtggtgatgaacggaatcgctcaaggaagatgcggatgggttatgcacgagatgggacacggatctttcactggagttatctggctcgatgataggatgtgcgagttcttctacggagttggatgtggaatgtctggacactactggaagaaccagcactctaagcaccacgctgctccaaacagattggagcacgatgtggatttgaacaccttgccactcgttgctttcaacgagagagttgtgaggaaggttaagccaggatctttgttggctttgtggctcagagttcaggcttatttgttcgctccagtgtcttgcttgttgatcggattgggatggaccttgtacttgcacccaagatatatgctcaggaccaagagacacatggagtttgtgtggatcttcgctagatatatcggatggttctccttgatgggagctttgggatattctcctggaacttctgtgggaatgtacctctgctctttcggacttggatgcatctacatcttcctccaattcgctgtgtctcacacccacttgccagttaccaacccagaggatcaattgcactggcttgagtacgctgctgatcacaccgtgaacatctctaccaagtcttggttggttacctggtggatgtctaacctcaacttccaaatcgagcaccacttgttcccaaccgctccacaattcaggttcaaggagatctctccaagagttgaggctctcttcaagagacacaacctcccttactacgatttgccatacacctctgctgtttctactaccttcgctaacctctactctgttggacactctgttggagctgataccaagaagcaggattgactgctttaatgagatatgcgagacgcctatgatcgcatgatatttgctttcaattctgttgtgcacgttgtaaaaaacctgagcatgtgtagctcagatccttaccgccggtttcggttcattctaatgaatatatcacccgttactatcgtatttttatgaataatattctccgttcaatttactgattgtctacgtaggctcagctgagcttacctaaggctacgtaggctcacgtgacgttacgtaaggctacgtagcgtcacgtgagcttacctaactctagctagcctcacgtgaccttagctaacactaggtagcgtcagctcgacggcccggactgtatccaacttctgatctttgaatctctctgttccaacatgttctgaaggagttctaagacttttcagaaagcttgtaacatgctttgtagactttctttgaattactcttgcaaactctgattgaacctacgtgaaaactgctccagaagttctaaccaaattccgtcttgggaaggcccaaaatttattgagtacttcagtttcatggacgtgtcttcaaagatttataacttgaaatcccatcatttttaagagaagttctgttccgcaatgtcttagatctcattgaaatctacaactcttgtgtcagaagttcttccagaatcaacttgcatcatggtgaaaatctggccagaagttctgaacttgtcatatttcttaacagttagaaaaatttctaagtgtttagaattttgacttttccaaagcaaacttgacttttgactttcttaataaaacaaacttcatattctaacatgtcttgatgaaatgtgattcttgaaatttgatgttgatgcaaaagtcaaagtttgacttttcagtgtgcaattgaccattttgctcttgtgccaattccaaacctaaattgatgtatcagtgctgcaaacttgatgtcatggaagatcttatgagaaaattcttgaagactgagaggaaaaattttgtagtacaacacaaagaatcctgtttttcatagtcggactagacacattaacataaaacaccacttcattcgaagagtgattgaagaaggaaatgtgcagttacctttctgcagttcataagagcaacttacagacacttttactaaaatactacaaagaggaagattttaacaacttagagaagtaatgggagttaaagagcaacacattaagggggagtgttaaaattaatgtgttgtaaccaccactacctttagtaagtattataagaaaattgtaatcatcacattataattattgtccttatttaaaattatgataaagttgtatcattaagattgagaaaaccaaatagtcctcgtcttgatttttgaattattgttttctatgttacttttcttcaagcctatataaaaactttgtaatgctaaattgtatgctggaaaaaaatgtgtaatgaattgaatagaaattatggtatttcaaagtccaaaatccatcaatagaaatttagtacaaaacgtaactcaaaaatattctcttattttaaattttacaacaatataaaaatattctcttattttaaattttacaataatataatttatcacctgtcacctttagaataccaccaacaatattaatacttagatattttattcttaataattttgagatctctcaatatatctgatatttattttatatttgtgtcatattttcttatgttttagagttaacccttatatcttggtcaaactagtaattcaatatatgagtttgtgaaggacacattgacatcttgaaacattggttttaaccttgttggaatgttaaaggtaataaaacattcagaattatgaccatctattaatatacttcctttgtcttttaaaaaagtgtgcatgaaaatgctctatggtaagctagagtgtcttgctggcctgtgtatatcaattccatttccagatggtagaaactgccactacgaataattagtcataagacacgtatgttaacacacgtccccttgcatgttttttgccatatattccgtctctttctttttcttcacgtataaaacaatgaactaattaatagagcgatcaagctgaacagttctttgctttcgaagttgccgcaacctaaacaggtttttccttcttctttcttcttattaactacgaccttgtcctttgcctatgtaaaattactaggttttcatcagttacactgattaagttcgttatagtggaagataaaatgccctcaaagcattttgcaggatatctttgatttttcaaagatatggaactgtagagtttgatagtgttcttgaatgtggttgcatgaagtttttttggtctgcatgttattttttcctcgaaatatgttttgagtccaacaagtgattcacttgggattcagaaagttgttttctcaatatgtaacagtttttttctatggagaaaaatcatagggaccgttggttttggcttctttaattttgagctcagattaaacccattttacccggtgttcttggcagaattgaaaacagtacgtagtaccgcgcctaccatgtgtgttgagaccgagaacaacgatggaatccctactgtggagatcgctttcgatggagagagagaaagagctgaggctaacgtgaagttgtctgctgagaagatggaacctgctgctttggctaagaccttcgctagaagatacgtggttatcgagggagttgagtacgatgtgaccgatttcaaacatcctggaggaaccgtgattttctacgctctctctaacactggagctgatgctactgaggctttcaaggagttccaccacagatctagaaaggctaggaaggctttggctgctttgccttctagacctgctaagaccgctaaagtggatgatgctgagatgctccaggatttcgctaagtggagaaaggagttggagagggacggattcttcaagccttctcctgctcatgttgcttacagattcgctgagttggctgctatgtacgctttgggaacctacttgatgtacgctagatacgttgtgtcctctgtgttggtttacgcttgcttcttcggagctagatgtggatgggttcaacacgagggaggacactcttctttgaccggaaacatctggtgggataagagaatccaagctttcactgctggattcggattggctggatctggagatatgtggaactccatgcacaacaagcaccacgctactcctcaaaaagtgaggcacgatatggatttggataccactcctgctgttgctttcttcaacaccgctgtggaggataatagacctaggggattctctaagtactggctcagattgcaagcttggaccttcattcctgtgacttctggattggtgttgctcttctggatgttcttcctccacccttctaaggctttgaagggaggaaagtacgaggagcttgtgtggatgttggctgctcacgtgattagaacctggaccattaaggctgttactggattcaccgctatgcaatcctacggactcttcttggctacttcttgggtttccggatgctacttgttcgctcacttctctacttctcacacccacttggatgttgttcctgctgatgagcacttgtcttgggttaggtacgctgtggatcacaccattgatatcgatccttctcagggatgggttaactggttgatgggatacttgaactgccaagtgattcaccacctcttcccttctatgcctcaattcagacaacctgaggtgtccagaagattcgttgctttcgctaagaagtggaacctcaactacaaggtgatgacttatgctggagcttggaaggctactttgggaaacctcgataatgtgggaaagcactactacgtgcacggacaacactctggaaagaccgcttgattaatgaaggccgcctcgaccgtaccccctgcagatagactatactatgttttagcctgcctgctggctagctactatgttatgttatgttgtaaaataaacacctgctaaggtatatctatctatattttagcatggctttctcaataaattgtctttccttatcgtttactatcttatacctaataatgaaataataatatcacatatgaggaacggggcaggtttaggcatatatatacgagtgtagggcggagtggggctacgtagcgtcacgtgacgttacctaagcctaggtagcctcagctgacgttacgtaacgctaggtaggctcagctgacacgggcaggacatagggactactacaagcatagtatgcttcagacaaagagctaggaaagaactcttgatggaggttaagagaaaaaagtgctagaggggcatagtaatcaaacttgtcaaaaccgtcatcatgatgagggatgacataatataaaaagttgactaaggtcttggtagtactctttgattagtattatatattggtgagaacatgagtcaagaggagacaagaaaccgaggaaccatagtttagcaacaagatggaagttgcaaagttgagctagccgctcgattagttacatctcctaagcagtactacaaggaatggtctctatactttcatgtttagcacatggtagtgcggattgacaagttagaaacagtgcttaggagacaaagagtcagtaaaggtattgaaagagtgaagttgatgctcgacaggtcaggagaagtccctccgccagatggtgactaccaaggggttggtatcagctgagacccaaataagattcttcggttgaaccagtggttcgaccgagactcttagggtgggatttcactgtaagatttgtgcattttgttgaatataaattgacaattttttttatttaattatagattatttagaatgaattacatatttagtttctaacaaggatagcaatggatgggtatgggtacaggttaaacatatctattacccacccatctagtcgtcgggttttacacgtacccacccgtttacataaaccagaccggaattttaaaccgtacccgtccgttagcgggtttcagatttacccgtttaatcgggtaaaacctgattactaaatatatattttttatttgataaacaaaacaaaaatgttaatattttcatattggatgcaattttaagaaacacatattcataaatttccatatttgtaggaaaataaaaagaaaaatatattcaagaacacaaatttcaccgacatgacttttattacagagttggaattagatctaacaattgaaaaattaaaattaagatagaatatgttgaggaacatgacatagtataatgctgggttacccgtcgggtaggtatcgaggcggatactactaaatccatcccactcgctatccgataatcactggtttcgggtatacccattcccgtcaacaggcctttttaaccggataatttcaacttatagtgaatgaattttgaataaatagttagaataccaaaatcctggattgcatttgcaatcaaattttgtgaaccgttaaattttgcatgtacttgggatagatataatagaaccgaattttcattagtttaatttataacttactttgttcaaagaaaaaaaatatctatccaatttacttataataaaaaataatctatccaagttacttattataatcaacttgtaaaaaggtaagaatacaaatgtggtagcgtacgtgtgattatatgtgacgaaatgttatatctaacaaaagtccaaattcccatggtaaaaaaaatcaaaatgcatggcaggctgtttgtaaccttggaataagatgttggccaattctggagccgccacgtacgcaagactcagggccacgttctcttcatgcaaggatagtagaacaccactccacccacctcctatattagacctttgcccaaccctccccaactttcccatcccatccacaaagaaaccgacatttttatcataaatctggtgcttaaacactctggtgagttctagtacttctgctatgatcgatctcattaccatttcttaaatttctctccctaaatattccgagttcttgatttttgataacttcaggttttctctttttgataaatctggtctttccattttttttttttgtggttaatttagtttcctatgttcttcgattgtattatgcatgatctgtgtttggattctgttagattatgtattggtgaatatgtatgtgtttttgcatgtctggttttggtcttaaaaatgttcaaatctgatgatttgattgaagcttttttagtgttggtttgattcttctcaaaactactgttaatttactatcatgttttccaactttgattcatgatgacacttttgttctgctttgttataaaattttggttggtttgattttgtaattatagtgtaattttgttaggaatgaacatgttttaatactctgttttcgatttgtcacacattcgaattattaatcgataatttaactgaaaattcatggttctagatcttgttgtcatcagattatttgtttcgataattcatcaaatatgtagtccttttgctgatttgcgactgtttcattttttctcaaaattgttttttgttaagtttatctaacagttatcgttgtcaaaagtctctttcattttgcaaaatcttctttttttttttgtttgtaactttgttttttaagctacacatttagtctgtaaaatagcatcgaggaacagttgtcttagtagacttgcatgttcttgtaacttctatttgtttcagtttgttgatgactgctttgattttgtaggtcaaaggcgcaccctaccatggatgcttataacgctgctatggataagattggagctgctatcatcgattggagtgatccagatggaaagttcagagctgatagggaggattggtggttgtgcgatttcagatccgctatcaccattgctctcatctacatcgctttcgtgatcttgggatctgctgtgatgcaatctctcccagctatggacccataccctatcaagttcctctacaacgtgtctcaaatcttcctctgcgcttacatgactgttgaggctggattcctcgcttataggaacggatacaccgttatgccatgcaaccacttcaacgtgaacgatccaccagttgctaacttgctctggctcttctacatctccaaagtgtgggatttctgggataccatcttcattgtgctcggaaagaagtggagacaactctctttcttgcacgtgtaccaccacaccaccatcttcctcttctactggttgaacgctaacgtgctctacgatggagatatcttcttgaccatcctcctcaacggattcattcacaccgtgatgtacacctactacttcatctgcatgcacaccaaggattctaagaccggaaagtctttgccaatctggtggaagtcatctttgaccgctttccaactcttgcaattcaccatcatgatgtcccaagctacctacttggttttccacggatgcgataaggtttccctcagaatcaccatcgtgtacttcgtgtacattctctcccttttcttcctcttcgctcagttcttcgtgcaatcctacatggctccaaagaagaagaagtccgcttgatgttaatgaaggccgcagatatcagatctggtcgacctagaggatccccggccgcaaagataataacaaaagcctactatataacgtacatgcaagtattgtatgatattaatgtttttacgtacgtgtaaacaaaaataattacgtttgtaacgtatggtgatgatgtggtgcactaggtgtaggccttgtattaataaaaagaagtttgttctatatagagtggtttagtacgacgatttatttactagtcggattggaatagagaaccgaattcttcaatccttgcttttgatcaagaattgaaaccgaatcaaatgtaaaagttgatatatttgaaaaacgtattgagcttatgaaaatgctaatactctcatctgtatggaaaagtgactttaaaaccgaacttaaaagtgacaaaaggggaatatcgcatcaaaccgaatgaaaccgatctacgtaggctcagctgagcttagctaagcctacctagcctcacgtgagattatgtaaggctaggtagcgtcacgtgacgttacctaacactagctagcgtcagctgagcttagctaaccctacgtagcctcacgtgagcttacctaacgctacgtagcctcacgtgactaaggatgacctacccattcttgagacaaatgttacattttagtatcagagtaaaatgtgtacctataactcaaattcgattgacatgtatccattcaacataaaattaaaccagcctgcacctgcatccacatttcaagtattttcaaaccgttcggctcctatccaccgggtgtaacaagacggattccgaatttggaagattttgactcaaattcccaatttatattgaccgtgactaaatcaactttaacttctataattctgattaagctcccaatttatattcccaacggcactacctccaaaatttatagactctcatccccttttaaaccaacttagtaaacgttttttttttaattttatgaagttaagtttttaccttgtttttaaaaagaatcgttcataagatgccatgccagaacattagctacacgttacacatagcatgcagccgcggagaattgtttttcttcgccacttgtcactcccttcaaacacctaagagcttctctctcacagcacacacatacaatcacatgcgtgcatgcattattacacgtgatcgccatgcaaatctcctttatagcctataaattaactcatcggcttcactctttactcaaaccaaaactcatcaatacaaacaagattaaaaacatttcacgatttggaatttgattcctgcgatcacaggtatgacaggttagattttgttttgtatagttgtatacatacttctttgtgatgttttgtttacttaatcgaatttttggagtgttttaaggtctctcgtttagaaatcgtggaaaatatcactgtgtgtgtgttcttatgattcacagtgtttatgggtttcatgttctttgttttatcattgaatgggaagaaatttcgttgggatacaaatttctcatgttcttactgatcgttattaggagtttggggaaaaaggaagagtttttttggttggttcgagtgattatgaggttatttctgtatttgatttatgagttaatggtcgttttaatgttgtagaccgccatggctattttgaaccctgaggctgattctgctgctaacctcgctactgattctgaggctaagcaaagacaattggctgaggctggatacactcacgttgagggtgctcctgctcctttgcctttggagttgcctcacttctctctcagagatctcagagctgctattcctaagcactgcttcgagagatctttcgtgacctccacctactacatgatcaagaacgtgttgacttgcgctgctttgttatacgctgctaccttcattgatagagctggagctgctgcttatgttttgtggcctgtgtactggttcttccagggatcttacttgactggagtgtgggttatcgctcacgagtgtggacaccaggcttattgctcttctgaggtggtgaacaacttgattggactcgtgttgcactctgctttgttggtgccttaccactcttggagaatctctcacagaaagcaccactccaacactggatcttgcgagaacgatgaggttttcgttcctgtgaccagatctgtgttggcttcttcttggaacgagaccttggaggattctcctctctaccaactctaccgtatcgtgtacatgttggttgttggatggatgcctggatacctcttcttcaacgctactggacctactaagtactggggaaagtctaggtctcacttcaacccttactccgctatctatgctgatagggagaggtggatgatcgtgctctccgatattttcttggtggctatgttggctgttttggctgctttggtgcacactttctccttcaacacgatggtgaagttctacgtggtgccttacttcattgtgaacgcttacttggtgttgattacctacctccaacacaccgatacctacatccctcacttcagagagggagagtggaattggttgagaggagctttgtgcactgtggatagatcatttggtccattcctcgattctgtggtgcatagaatcgtggatacccacgtttgccaccatatcttctccaagatgcctttctatcactgcgaggaggctaccaacgctattaagcctctcctcggaaagttctacttgaaggatactactcctgttcctgttgctctctggagatcttacacccactgcaagttcgttgaggatgatggaaaggtggtgttctacaagaacaagttatagttaatgaataattgattggttcgagtattatggcattgggaaaactgtttttcttgtaccatttgttgtgcttgtaatttactgtgttttttattcggttttcgctatcgaactgtgaaatggaaatggatggagaagagttaatgaatgatatggtccttttgttcattctcaaattaatattatttgttttttctcttatttgttgtgtgttgaatttgaaattataagagatatgcaaacattttgttttgagtaaaaatgtgtcaaatcgtggcctctaatgaccgaagttaatatgaggagtaaaacacttgtagttgtaccattatgcttattcactaggcaacaaatatattttcagacctagaaaagctgcaaatgttactgaatacaagtatgtcctcttgtgttttagacatttatgaactttcctttatgtaattttccagaatccttgtcagattctaatcattgctttataattatagttatactcatggatttgtagttgagtatgaaaatattttttaatgcattttatgacttgccaattgattgacaacatgcatcaatctagctagcctcagctgacgttacgtaacgctaggtagcgtcacgtgacgttagctaacgctaggtagcgtcagctgagcttacgtaagcgcacagatgaatactagctgttgttcacagttctagtgtctcctcattacgtgaattcaagctacgatcactatctcaactcctacataaacatcagaatgctacaaaactatgcacaaaaacaaaagctacatctaatacgtgaatcaattactctcatcacaagaaagaagatttcaatcaccgtcgagaaggaggattcagttaattgaatcaaagttccgatcaaactcgaagactggtgagcacgaggacgacgaagaagagtgtctcgaagatacaacaagcaagaaatctactgagtgacctcctgaagttattggcgcgattgagagaatcaatccgaattaatttcggggaaaaagataaattagatactaagcgatgggcttgggctgggctaagaaacaggtggcaattgggctggaggaccccgcgattcatagcttccgatagcccaaaaaaaaacggataacatatttatcgggtatttgaatttcagtgaaataagatattttctttttgttaggaaaattttagaaaataatggaaattaaatagcgattatgttacaagatacgatcagcatcgggcagtgcaaaatgctatagcttcccaagatttgatccttttgggttatctcctaatgacaattagtttaggattttgaaacttatattaatactattatccgacaacacttgtttcagcttcttattttaacattttttgtttttttctattcttcttcccatcagcattttctttttaaaaaattgaatactttaactttttaaaaatttcacaatgatcagatgatattatggaagatctcaagagttaaatgtatccatcttggggcattaaaaccggtgtacgggatgataaatacagactttatatcatatgatagctcagtaattcatatttatcacgttgctaaaaaaattataaggtactagtagtcaacaaaatcaattaaagagaaagaaagaaacgcatgtgaagagagtttacaactggaaaagtaaaataaaaattaacgcatgttgaatgctgacatgtcagtatgtccatgaatccacgtatcaagcgccattcatcgatcgtcttcctctttctaaatgaaaacaacttcacacatcacaacaaacaatacacacaagaccccctctctctcgttgtctctctgccagcgaccaaatcgaagcttgagaagaacaagaaggggtcaaaccatggcttctacatctgctgctcaagacgctgctccttacgagttcccttctctcactgagatcaagagggctcttccttctgagtgtttcgaggcttctgttcctctttctctctactacaccgctagatctcttgctcttgctggatctctcgctgttgctctctcttacgctagagctttgcctcttgttcaggctaacgctcttcttgatgctactctctgcactggatacgttcttctccagggaatcgttttctggggattcttcaccgttggtcacgattgtggacacggagctttctctagatctcacgtgctcaacttctctgttggaaccctcatgcactctatcatccttacccctttcgagtcttggaagctctctcacagacaccaccacaagaacaccggaaacatcgataaggacgagatcttctaccctcaaagagaggctgattctcaccctgtttctagacaccttgtgatgtctcttggatctgcttggttcgcttaccttttcgctggattccctcctagaaccatgaaccacttcaacccttgggaggctatgtatgttagaagagtggctgctgtgatcatctctctcggagttcttttcgctttcgctggactctactcttacctcaccttcgttcttggattcaccactatggctatctactacttcggacctctcttcatcttcgctaccatgcttgttgttaccactttcctccaccacaacgatgaggagacaccttggtacgctgattctgagtggacttacgtgaagggaaacctctcttctgtggacagatcttacggtgctctcatcgacaaccttagccacaacatcggaactcaccagatccaccacctcttccctatcatccctcactacaagctcaacgatgctactgctgctttcgctaaggctttccctgagcttgttaggaaaaacgctgctcctatcatcccaactttcttcaggatggctgctatgtacgctaagtacggagttgttgacactgatgctaagaccttcactctcaaggaggctaaggctgctgctaagactaagtcatcttgatgattaatgaataattgattgtacatactatattttttgtttaccttgtgttagtttaatgttcagtgtcctctctttattgtggcacgtctctttgttgtatgttgtgtctatacaaagttgaaataatggaaagaaaaggaagagtgtaatttgttttgttttaagtgtttataaatatatatatataggtcatttagatagttctaggtttctataaaactctctctctggaagtagaatctgtttttgagaggatccagttgcctactaatctcccccaaaacccttcaagcttaaccttcctcttcacaacaacagaggaaacacatctcttgagctctgagttctcttctttgagcatgtctatcgctaaactcatctgccttatagcttccctcttctcttcatctctctctctcaccatttcgctgtaaaacttattctcctccctcagcctctctatctcttccttcagcatctcacaattcccaccataatcgactgaggatgattcaccgtcatcaacttcagactcagcgttgtagtcgtcatgagtctcacaagccttggaccaagaagactcatcatcgcaagttgatgatttatcatgatgcttctctgagccgtgtttgctacgtagcgtcacgtgacgttacctaagcctaggtagcctcagctgacgttacgtaacgctaggtaggctcagctgactgcagcaaatttacacattgccactaaacgtctaaacccttgtaatttgtttttgttttactatgtgtgttatgtatttgatttgcgataaatttttatatttggtactaaatttataacaccttttatgctaacgtttgccaacacttagcaatttgcaagttgattaattgattctaaattatttttgtcttctaaatacatatactaatcaactggaaatgtaaatatttgctaatatttctactataggagaattaaagtgagtgaatatggtaccacaaggtttggagatttaattgttgcaatgctgcatggatggcatatacaccaaacattcaataattcttgaggataataatggtaccacacaagatttgaggtgcatgaacgtcacgtggacaaaaggtttagtaatttttcaagacaacaatgttaccacacacaagttttgaggtgcatgcatggatgccctgtggaaagtttaaaaatattttggaaatgatttgcatggaagccatgtgtaaaaccatgacatccacttggaggatgcaataatgaagaaaactacaaatttacatgcaactagttatgcatgtagtctatataatgaggattttgcaatactttcattcatacacactcactaagttttacacgattataatttcttcatagccagtactgtttaagcttcactgtctctgaatcggcaaaggtaaacgtatcaattattctacaaacccttttatttttcttttgaattaccgtcttcattggttatatgataacttgataagtaaagcttcaataattgaatttgatctgtgtttttttggccttaatactaaatccttacataagctttgttgcttctcctcttgtgagttgagtgttaagttgtaataatggttcactttcagctttagaagaaacgcgccttccatggctacaaaggaggcttacgttttcccaactctcaccgagatcaagagatctctcccaaaggattgcttcgaggcttctgtgcctttgtctctctactacactgtgagatgcttggttattgctgtggctttgaccttcggattgaactacgctagagctttgccagaggttgagtctttctgggctttggatgctgctttgtgcactggatatatcctcctccagggaattgtgttctggggattcttcactgttggacacgatgctggacacggagctttctctagataccacctcttgaacttcgttgtgggaaccttcatgcactctctcatcttgaccccattcgagtcttggaagttgacccacagacaccaccacaagaacaccggaaacatcgatagagatgaggtgttctacccacagagaaaggctgatgatcacccattgtccaggaacttgatcttggctttgggagctgcttggcttgcttatttggtggagggattcccaccaagaaaggtgaaccacttcaacccattcgagccactttttgtgagacaagtgtccgctgtggttatctctttgctcgctcacttcttcgttgctggactctctatctacttgtctctccagttgggacttaagaccatggctatctactactacggaccagttttcgtgttcggatctatgttggtgattaccaccttcttgcaccacaacgatgaggagactccatggtatgctgattctgagtggacttacgtgaagggaaacttgtcctctgtggatagatcttacggtgctctcatcgataacctctcccacaacatcggaactcaccagatccaccacctcttcccaattatcccacactacaagctcaagaaggctactgctgctttccaccaagctttcccagagcttgtgagaaagtccgatgagccaatcatcaaggctttcttcagagtgggaaggttgtatgctaactacggagtggttgatcaagaggctaagctcttcactttgaaggaggctaaggctgctactgaagctgctgctaagaccaagtctacctgattaatgaatcgacaagctcgagtttctccataataatgtgtgagtagttcccagataagggaattagggttcctatagggtttcgctcatgtgttgagcatataagaaacccttagtatgtatttgtatttgtaaaatacttctatcaataaaatttctaattcctaaaaccaaaatccagtactaaaatccagatcccccgaattaattcggcgttaattcagctacgtaggctcagctgagcttacctaaggctacgtaggctcacgtgacgttacgtaaggctacgtagcgtcacgtgagcttacctaactctagctagcctcacgtgaccttagctaacactaggtagcgtcagcacagatgaatactagctgttgttcacagttctagtgtctcctcattacgtgaattcaagctacgatcactatctcaactcctacataaacatcagaatgctacaaaactatgcacaaaaacaaaagctacatctaatacgtgaatcaattactctcatcacaagaaagaagatttcaatcaccgtcgagaaggaggattcagttaattgaatcaaagttccgatcaaactcgaagactggtgagcacgaggacgacgaagaagagtgtctcgaagatacaacaagcaagaaatctactgagtgacctcctgaagttattggcgcgattgagagaatcaatccgaattaatttcggggaaaaagataaattagatactaagcgatgggcttgggctgggctaagaaacaggtggcaattgggctggaggaccccgcgattcatagcttccgatagcccaaaaaaaaacggataacatatttatcgggtatttgaatttcagtgaaataagatattttctttttgttaggaaaattttagaaaataatggaaattaaatagcgattatgttacaagatacgatcagcatcgggcagtgcaaaatgctatagcttcccaagatttgatccttttgggttatctcctaatgacaattagtttaggattttgaaacttatattaatactattatccgacaacacttgtttcagcttcttattttaacattttttgtttttttctattcttcttcccatcagcattttctttttaaaaaattgaatactttaactttttaaaaatttcacaatgatcagatgatattatggaagatctcaagagttaaatgtatccatcttggggcattaaaaccggtgtacgggatgataaatacagactttatatcatatgatagctcagtaattcatatttatcacgttgctaaaaaaattataaggtactagtagtcaacaaaatcaattaaagagaaagaaagaaacgcatgtgaagagagtttacaactggaaaagtaaaataaaaattaacgcatgttgaatgctgacatgtcagtatgtccatgaatccacgtatcaagcgccattcatcgatcgtcttcctctttctaaatgaaaacaacttcacacatcacaacaaacaatacacacaagaccccctctctctcgttgtctctctgccagcgaccaaatcgaagcttgagaagaacaagaaggggtcaaaccatgggaaaaggatctgagggaagatctgctgctagagagatgactgctgaggctaacggagataagagaaagaccatcctcattgagggagtgttgtacgatgctaccaacttcaaacacccaggaggttccattattaacttcctcaccgagggagaagctggagttgatgctacccaagcttacagagagttccatcagagatccggaaaggctgataagtacctcaagtccctcccaaagttggatgcttctaaggtggagtctaggttctctgctaaggagcaggctagaagggacgctatgaccagggattacgctgctttcagagaggagttggttgctgagggatacttcgatccatctatcccacacatgatctacagagtggtggagattgtggctttgttcgctttgtctttctggttgatgtctaaggcttctccaacctctttggttttgggagtggtgatgaacggaatcgctcaaggaagatgcggatgggttatgcacgagatgggacacggatctttcactggagttatctggctcgatgataggatgtgcgagttcttctacggagttggatgtggaatgtctggacactactggaagaaccagcactctaagcaccacgctgctccaaacagattggagcacgatgtggatttgaacaccttgccactcgttgctttcaacgagagagttgtgaggaaggttaagccaggatctttgttggctttgtggctcagagttcaggcttatttgttcgctccagtgtcttgcttgttgatcggattgggatggaccttgtacttgcacccaagatatatgctcaggaccaagagacacatggagtttgtgtggatcttcgctagatatatcggatggttctccttgatgggagctttgggatattctcctggaacttctgtgggaatgtacctctgctctttcggacttggatgcatctacatcttcctccaattcgctgtgtctcacacccacttgccagttaccaacccagaggatcaattgcactggcttgagtacgctgctgatcacaccgtgaacatctctaccaagtcttggttggttacctggtggatgtctaacctcaacttccaaatcgagcaccacttgttcccaaccgctccacaattcaggttcaaggagatctctccaagagttgaggctctcttcaagagacacaacctcccttactacgatttgccatacacctctgctgtttctactaccttcgctaacctctactctgttggacactctgttggagctgataccaagaagcaggattgatgattaatgaataattgattgtacatactatattttttgtttaccttgtgttagtttaatgttcagtgtcctctctttattgtggcacgtctctttgttgtatgttgtgtctatacaaagttgaaataatggaaagaaaaggaagagtgtaatttgttttgttttaagtgtttataaatatatatatataggtcatttagatagttctaggtttctataaaactctctctctggaagtagaatctgtttttgagaggatccagttgcctactaatctcccccaaaacccttcaagcttaaccttcctcttcacaacaacagaggaaacacatctcttgagctctgagttctcttctttgagcatgtctatcgctaaactcatctgccttatagcttccctcttctcttcatctctctctctcaccatttcgctgtaaaacttattctcctccctcagcctctctatctcttccttcagcatctcacaattcccaccataatcgactgaggatgattcaccgtcatcaacttcagactcagcgttgtagtcgtcatgagtctcacaagccttggaccaagaagactcatcatcgcaagttgatgatttatcatgatgcttctctgagccgtgtttgctacctagagtcagctgagcttagctaacgctagctagtgtcagctgacgttacgtaaggctaactagcgtcacgtgaccttacgtaacgctacgtaggctcagctgagcttagctaaccctagctagtgtcacgtgagcttacgctactatagaaaatgtgttatatcgacatgaccagacaaaggggcaacagttaacaaaacaattaattctttcatttgagattaaggaaggtaaggtactaaaaagattaaaaaaaatgagcttatctctttgtttctgtaataataatataagtgtgataaacttttaatataataattgtaattaggttttctacagatgagcaccactcagagacaagataagaagaaaacaattttgttaaacatgattatagaaacttttagttaagtcttgaagtatcaatataacaaaaaaaagtacacacgactatgacaataaacccactaccgtcaggttatcatttcgatgaaatgttttgatatcattaaatataacagtcacaaaaaatcatctaattataacaatataacttatacatatatttaactaaaaacttagagtttttgtaatgattctaattgatgattagagtttatagaaatacaattaaataaaaaatataattttaaaaaaacatagtaaagtcaatgagatcctctctgacctcagtgatcatttagtcatgtatgtacaacaatcattgttcatcacatgactgtaaaataaataaggataaacttgggaatatatataatatattgtattaaataaaaaagggaaatacaaatatcaattttagattcccgagttgacacaactcaccatgcacgctgccacctcagctcccagctctcgtcacatgtctcatgtcagttaggtctttggtttttagtctttgacacaactcgccatgcatgttgccacgtgagctcgttcctcttcccatgatctcaccactgggcatgcatgctgccacctcagctggcacctcttctctatatgtccctagaggccatgcacagtgccacctcagcactcctctcagaacccatacgtacctgccaatcggcttctctccataaatatctatttaaattataactaattatttcatatacttaattgatgacgtggatgcattgccatcgttgtttaataattgttaattacgacatgataaataaaatgaaagtaaaaagtacgaaagattttccatttgttgttgtataaatagagaagtgagtgatgcataatgcatgaatgcatgaccgcgccaccatgactgttggatacgacgaggagatcccattcgagcaagttagggctcataacaagccagacgacgcttggtgtgctattcacggacacgtgtacgacgttaccaagttcgcttcagttcacccaggaggagatattatcttgctcgctgctggaaaggaagctactgtcctctacgagacctaccatgttagaggagtgtctgacgctgtgctcagaaagtacagaataggaaagttgccagacggacaaggaggagctaacgagaaggagaagagaaccttgtctggattgtcctctgcttcttactacacctggaactccgatttctacagagtgatgagggagagagttgtggctagattgaaggagagaggaaaggctagaagaggaggatacgaactctggatcaaggctttcttgctccttgttggattctggtcctctctttactggatgtgcaccctcgatccatctttcggagctatcttggctgctatgtctttgggagtgttcgctgcttttgttggaacctgcatccaacacgatggaaaccacggagctttcgctcaatctagatgggttaacaaggtggcaggatggactttggatatgatcggagcttctggaatgacttgggagttccaacacgtgttgggacaccacccatacactaacttgatcgaggaggagaacggattgcaaaaggtgtccggaaagaagatggataccaagttggctgatcaagagtctgatccagatgtgttctccacctacccaatgatgagattgcacccttggcaccagaagaggtggtatcacaggttccagcacatctacggacctttcatcttcggattcatgaccatcaacaaggtggtgactcaagatgttggagtggtgttgagaaagagactcttccaaatcgatgctgagtgcagatatgcttccccaatgtacgttgctaggttctggattatgaaggctttgaccgtgttgtatatggttgctttgccttgttatatgcaaggaccttggcacggattgaaactcttcgctatcgctcacttcacttgcggagaggttttggctaccatgttcatcgtgaaccacattatcgagggagtgtcttacgcttctaaggatgctgttaagggaactatggctccaccaaagactatgcacggagtgaccccaatgaacaacactagaaaggaggttgaggctgaggcttctaagtctggagctgtggttaagtctgtgccattggatgattgggctgctgttcagtgccaaacctctgtgaactggtctgttggatcttggttttggaaccacttctctggaggactcaaccaccaaatcgagcaccacctcttcccaggattgtctcacgagacctactaccacatccaagacgtggttcaatctacctgtgctgagtacggagttccataccaacacgagccatctttgtggactgcttactggaagatgctcgaacaccttagacaattgggaaacgaggagactcacgagtcatggcagagagctgcttgattaatgaactaagactcccaaaaccaccttccctgtgacagttaaaccctgcttatacctttcctcctaataatgttcatctgtcacacaaactaaaataaataaaatgggagcaataaataaaatgggagctcatatatttacaccatttacactgtctattattcaccatgccaattattacttcataattttaaaattatgtcatttttaaaaattgcttaatgatggaaaggattattataagttaaaagtataacatagataaactaaccacaaaacaaatcaatataaactaacttactctcccatctaatttttatttaaatttctttacacttctcttccatttctatttctacaacattatttaacatttttattgtatttttcttactttctaactctattcatttcaaaaatcaatatatgtttatcaccacctctctaaaaaaaactttacaatcattggtccagaaaagttaaatcacgagatggtcattttagcattaaaacaacgattcttgtatcactatttttcagcatgtagtccattctcttcaaacaaagacagcggctatataatcgttgtgttatattcagtctaaaacaactagctagcctcagctgacgttacgtaacgctaggtagcgtcacgtgacgttagctaacgctaggtagcgtcagctgagcttacgtaagcgccacgggcaggacatagggactactacaagcatagtatgcttcagacaaagagctaggaaagaactcttgatggaggttaagagaaaaaagtgctagaggggcatagtaatcaaacttgtcaaaaccgtcatcatgatgagggatgacataatataaaaagttgactaaggtcttggtagtactctttgattagtattatatattggtgagaacatgagtcaagaggagacaagaaaccgaggaaccatagtttagcaacaagatggaagttgcaaagttgagctagccgctcgattagttacatctcctaagcagtactacaaggaatggtctctatactttcatgtttagcacatggtagtgcggattgacaagttagaaacagtgcttaggagacaaagagtcagtaaaggtattgaaagagtgaagttgatgctcgacaggtcaggagaagtccctccgccagatggtgactaccaaggggttggtatcagctgagacccaaataagattcttcggttgaaccagtggttcgaccgagactcttagggtgggatttcactgtaagatttgtgcattttgttgaatataaattgacaattttttttatttaattatagattatttagaatgaattacatatttagtttctaacaaggatagcaatggatgggtatgggtacaggttaaacatatctattacccacccatctagtcgtcgggttttacacgtacccacccgtttacataaaccagaacggaattttaaaccgtacccgtccgttagcgggtttcagatttacccgtttaatcgggtaaaacctgattactaaatatatattttttatttgataaacaaaacaaaaatgttaatattttcatattggatgcaattttaagaaacacatattcataaatttccatatttgtaggaaaataaaaagaaaaatatattcaagaacacaaatttcaccgacatgacttttattacagagttggaattagatctaacaattgaaaaattaaaattaagatagaatatgttgaggaacatgacatagtataatgctgggttacccgtcgggtaggtatcgaggcggatactactaaatccatcccactcgctatccgataatcactggtttcgggtatacccattcccgtcaacaggcctttttaaccggataatttcaacttatagtgaatgaattttgaataaatagttagaataccaaaatcctggattgcatttgcaatcaaattttgtgaaccgttaaattttgcatgtacttgggatagatataatagaaccgaattttcattagtttaatttataacttactttgttcaaagaaaaaaaatatctatccaatttacttataataaaaaataatctatccaagttacttattataatcaacttgtaaaaaggtaagaatacaaatgtggtagcgtacgtgtgattatatgtgacgaaatgttatatctaacaaaagtccaaattcccatggtaaaaaaaatcaaaatgcatggcaggctgtttgtaaccttggaataagatgttggccaattctggagccgccacgtacgcaagactcagggccacgttctcttcatgcaaggatagtagaacaccactccacccacctcctatattagacctttgcccaaccctccccaactttcccatcccatccacaaagaaaccgacatttttatcataaatcagggtttcgtttttgtttcatcgataaactcaaaggtgatgattttagggtcttgtgagtgtgcttttttgtttgattctactgtagggtttatgttctttagctcataggttttgtgtatttcttagaaatgtggcttctttaatctctgggtttgtgactttttgtgtggtttctgtgtttttcatatcaaaaacctattttttccgagtttttttttacaaattcttactctcaagcttgaatacttcacatgcagtgttcttttgtagattttagagttaatgtgttaaaaagtttggatttttcttgcttatagagcttcttcactttgattttgtgggtttttttgttttaaaggtgagatttttgatgaggtttttgcttcaaagatgtcacctttctgggtttgtcttttgaataaagctatgaactgtcacatggctgacgcaattttgttactatgtcatgaaagctgacgtttttccgtgttatacatgtttgcttacacttgcatgcgtcaaaaaaattggggctttttagttttagtcaaagattttacttctcttttgggatttatgaaggaaagttgcaaactttctcaaattttaccatttttgctttgatgtttgtttagattgcgacagaacaaactcatatatgttgaaatttttgcttggttttgtataggattgtgtcttttgcttataaatgttgaaatctgaactttttttttgtttggtttctttgagcaggagataaggcgcaccaccatggcttctacatctgctgctcaagacgctgctccttacgagttcccttctctcactgagatcaagagggctcttccttctgagtgtttcgaggcttctgttcctctttctctctactacaccgctagatctcttgctcttgctggatctctcgctgttgctctctcttacgctagagctttgcctcttgttcaggctaacgctcttcttgatgctactctctgcactggatacgttcttctccagggaatcgttttctggggattcttcaccgttggtcacgattgtggacacggagctttctctagatctcacgtgctcaacttctctgttggaaccctcatgcactctatcatccttacccctttcgagtcttggaagctctctcacagacaccaccacaagaacaccggaaacatcgataaggacgagatcttctaccctcaaagagaggctgattctcaccctgtttctagacaccttgtgatgtctcttggatctgcttggttcgcttaccttttcgctggattccctcctagaaccatgaaccacttcaacccttgggaggctatgtatgttagaagagtggctgctgtgatcatctctctcggagttcttttcgctttcgctggactctactcttacctcaccttcgttcttggattcaccactatggctatctactacttcggacctctcttcatcttcgctaccatgcttgttgttaccactttcctccaccacaacgatgaggagacaccttggtacgctgattctgagtggacttacgtgaagggaaacctctcttctgtggacagatcttacggtgctctcatcgacaaccttagccacaacatcggaactcaccagatccaccacctcttccctatcatccctcactacaagctcaacgatgctactgctgctttcgctaaggctttccctgagcttgttaggaaaaacgctgctcctatcatcccaactttcttcaggatggctgctatgtacgctaagtacggagttgttgacactgatgctaagaccttcactctcaaggaggctaaggctgctgctaagactaagtcatcttgatgattaatgaaggccgcagatatcagatctggtcgacctagaggatccccggccgcaaagataataacaaaagcctactatataacgtacatgcaagtattgtatgatattaatgtttttacgtacgtgtaaacaaaaataattacgtttgtaacgtatggtgatgatgtggtgcactaggtgtaggccttgtattaataaaaagaagtttgttctatatagagtggtttagtacgacgatttatttactagtcggattggaatagagaaccgaattcttcaatccttgcttttgatcaagaattgaaaccgaatcaaatgtaaaagttgatatatttgaaaaacgtattgagcttatgaaaatgctaatactctcatctgtatggaaaagtgactttaaaaccgaacttaaaagtgacaaaaggggaatatcgcatcaaaccgaatgaaaccgatctacgtaggctcagctgagcttacctaaggctacgtaggctcacgtgacgttacgtaaggctacgtagcgtcacgtgagcttacctaactctagctagcctcacgtgaccttagctaacactaggtagcgtcagcttagcagatatttggtgtctaaatgtttattttgtgatatgttcatgtttgaaatggtggtttcgaaaccagggacaacgttgggatctgatagggtgtcaaagagtattatggattgggacaatttcggtcatgagttgcaaattcaagtatatcgttcgattatgaaaattttcgaagaatatcccatttgagagagtctttacctcattaatgtttttagattatgaaattttatcatagttcatcgtagtctttttggtgtaaaggctgtaaaaagaaattgttcacttttgttttcgtttatgtgaaggctgtaaaagattgtaaaagactattttggtgttttggataaaatgatagtttttatagattcttttgcttttagaagaaatacatttgaaattttttccatgttgagtataaaataccgaaatcgattgaagatcatagaaatattttaactgaaaacaaatttataactgattcaattctctccatttttatacctatttaaccgtaatcgattctaatagatgatcgattttttatataatcctaattaaccaacggcatgtattggataattaaccgatcaactctcacccctaatagaatcagtattttccttcgacgttaattgatcctacactatgtaggtcatatccatcgttttaatttttggccaccattcaattctgtcttgcctttagggatgtgaatatgaacggccaaggtaagagaataaaaataatccaaattaaagcaagagaggccaagtaagataatccaaatgtacacttgtcattgccaaaattagtaaaatactcggcatattgtattcccacacattattaaaataccgtatatgtattggctgcatttgcatgaataatactacgtgtaagcccaaaagaacccacgtgtagcccatgcaaagttaacactcacgaccccattcctcagtctccactatataaacccaccatccccaatctcaccaaacccaccacacaactcacaactcactctcacaccttaaagaaccaatcaccaccaaaaaaagttctttgctttcgaagttgccgcaacctaaacaggtttttccttcttctttcttcttattaactacgaccttgtcctttgcctatgtaaaattactaggttttcatcagttacactgattaagttcgttatagtggaagataaaatgccctcaaagcattttgcaggatatctttgatttttcaaagatatggaactgtagagtttgatagtgttcttgaatgtggttgcatgaagtttttttggtctgcatgttattttttcctcgaaatatgttttgagtccaacaagtgattcacttgggattcagaaagttgttttctcaatatgtaacagtttttttctatggagaaaaatcatagggaccgttggttttggcttctttaattttgagctcagattaaacccattttacccggtgttcttggcagaattgaaaacagtacgtagtaccgcgcctaccatgccacctagtgctgctagtgaaggtggtgttgctgaacttagagctgctgaagttgctagctacactagaaaggctgttgacgaaagacctgacctcactatagttggtgacgctgtttacgacgctaaggcttttagggacgagcaccctggtggtgctcacttcgttagccttttcggaggtagggacgctactgaggcttttatggaatatcaccgtagagcttggcctaaggctaggatgtctaagttcttcgttggttcacttgacgctagcgagaagcctactcaagctgattcagcttaccttagactttgcgctgaggttaacgctcttttgcctaagggtagcggaggattcgctcctcctagctactggcttaaggctgctgctcttgttgttgctgctgttagtatagagggttatatgctccttaggggtaagacccttttgcttagcgttttccttggactcgtgttcgcttggataggacttaatattcagcacgacgctaatcacggtgctcttagtagacactcagtgattaactactgcctcggttacgctcaggattggataggtggtaatatggtgctttggcttcaagagcacgttgtgatgcaccacctccacactaacgacgttgacgctgatcctgatcaaaaggctcacggtgttcttagacttaagcctactgacggttggatgccttggcacgcacttcaacaactctatatccttcctggtgaggctatgtacgcttttaagcttcttttcttggacgcccttgagcttcttgcttggaggtgggagggtgagaagattagccctcttgctagagctttgttcgctcctgctgttgcttgtaagcttggattctgggctagattcgttgctctccctctctggcttcaacctactgttcacactgctttgtgtatctgtgctactgtgtgtactggtagcttctacctcgccttcttcttctttatctctcacaacttcgacggtgttggtagcgttggacctaagggatcacttcctagatcagctactttcgttcaacgtcaggttgagactagctctaacgttggtggttactggcttggagttcttaacggtggacttaactttcagatagagcaccacttgttccctaggcttcaccactcttactacgctcaaatagctcctgtggttaggactcacatagagaagctcggttttaagtaccgtcacttccctaccgttggatctaaccttagctcaatgcttcagcatatgggtaagatgggaactagacctggtgctgagaagggtggtaaggctgagtagtgattaatgaataattgattgctgctttaatgagatatgcgagacgcctatgatcgcatgatatttgctttcaattctgttgtgcacgttgtaaaaaacctgagcatgtgtagctcagatccttaccgccggtttcggttcattctaatgaatatatcacccgttactatcgtatttttatgaataatattctccgttcaatttactgattgtctacgtagcgtcacctgacgttacgtaaggctacctaggctcacgtgacgttacgtaacgctacgtagcgtcaggtgaggttagctaacgctagctagcctcacctgacgttaggtaaggctacgtagcgtcacctgagattagctaagcctacctagactcacgtgaccttaggtaacgctacgtagcgtcaaagctttacaacgctacacaaaacttataaccgtaatcaccattcattaacttaactactatcacatgcattcatgaattgaaacgagaaggatgtaaatagttgggaagttatctccacgttgaagagatcgttagcgagagctgaaagaccgagggaggagacgccgtcaacacggacagagtcgtcgaccctcacatgaagtaggaggaatctccgtgaggagccagagagacgtctttggtcttcggtttcgatccttgatctgacggagaagacgagagaagtgcgactggactccgtgaggaccaacagagtcgtcctcggtttcgatcgtcggtattggtggagaaggcggaggaatctccgtgacgagccagagagatgtcgtcggtcttcggtttcgatccttgatctgacggagaagacgagagaagtgcgacgagactccgtgaggaccaacagagttgtcctcggtttcgatcgtcggtttcggcggagaaggcggaggaatctccgtgaggagccagagagacgtcgttggtcttcggtttcgatccttgatctgttggagaagacgagacaagtgggacgagactcaacgacggagtcagagacgtcgtcggtcttcggtttcggccgagaaggcggagtcggtcttcggtttcggccgagaaggcggaggagacgtcttcgatttgggtctctcctcttgacgaagaaaacaaagaacacgagaaataatgagaaagagaacaaaagaaaaaaaaataaaaataaaaataaaatttggtcctcttatgtggtgacacgtggtttgaaacccaccaaataatcgatcacaaaaaacctaagttaaggatcggtaataacctttctaattaattttgatttatattaaatcactctttttatttataaaccccactaaattatgcgatattgattgtctaagtacaaaaattctctcgaattcaatacacatgtttcatatatttagccctgttcatttaatattactagcgcatttttaatttaaaattttgtaaacttttttggtcaaagaacatttttttaattagagacagaaatctagactctttatttggaataatagtaataaagatatattaggcaatgagtttatgatgttatgtttatatagtttatttcattttaaattgaaaagcattatttttatcgaaatgaatctagtatacaatcaatatttatgttttttcatcagatactttcctattttttggcacctttcatcggactactgatttatttcaatgtgtatgcatgcatgagcatgagtatacacatgtcttttaaaatgcatgtaaagcgtaacggaccacaaaagaggatccatacaaatacatctcatcgcttcctctactattctccgacacacacactgagcatggtgcttaaacactctggtgagttctagtacttctgctatgatcgatctcattaccatttcttaaatttctctccctaaatattccgagttcttgatttttgataacttcaggttttctctttttgataaatctggtctttccatttttttttttttgtggttaatttagtttcctatgttcttcgattgtattatgcatgatctgtgtttggattctgttagattatgtattggtgaatatgtatgtgtttttgcatgtctggttttggtcttaaaaatgttcaaatctgatgatttgattgaagcttttttagtgttggtttgattcttctcaaaactactgttaatttactatcatgttttccaactttgattcatgatgacacttttgttctgctttgttataaaattttggttggtttgattttgtaattatagtgtaattttgttaggaatgaacatgttttaatactctgttttcgatttgtcacacattcgaattattaatcgataatttaactgaaaattcatggttctagatcttgttgtcatcagattatttgtttcgataattcatcaaatatgtagtccttttgctgatttgcgactgtttcattttttctcaaaattgttttttgttaagtttatctaacagttatcgttgtcaaaagtctctttcattttgcaaaatcttctttttttttttgtttgtaactttgttttttaagctacacatttagtctgtaaaatagcatcgaggaacagttgtcttagtagacttgcatgttcttgtaacttctatttgtttcagtttgttgatgactgctttgattttgtaggtcaaaccgcgccatgtctgctagcggagctttgttgcctgctatagctttcgctgcttacgcttacgctacctacgcttatgctttcgagtggagccacgctaacggaatcgataacgtggatgctagagagtggattggagctttgtctttgagactccctgcaattgcaaccacaatgtacctcttgttctgccttgtgggacctagattgatggctaagagggaggcttttgatcctaagggatttatgctcgcttacaacgcttaccaaaccgctttcaacgttgtggtgctcggaatgttcgctagagagatctctggattgggacaacctgtttggggatctactatgccttggagcgataggaagtccttcaagattttgttgggagtgtggctccactacaacaataagtacctcgagttgttggatactgtgttcatggtggctaggaaaaagaccaagcagctctctttcttgcacgtgtaccaccacgctttgttgatttgggcttggtggcttgtttgtcacctcatggctaccaacgattgcatcgatgcttatttcggagctgcttgcaactctttcatccacatcgtgatgtactcctactacctcatgtctgctttgggaattaggtgcccttggaagagatatatcacccaggctcagatgttgcaattcgtgatcgtgttcgctcacgctgttttcgtgctcagacaaaagcactgccctgttactttgccttgggcacaaatgttcgtgatgacaaatatgttggtgctcttcggaaacttctacctcaaggcttactctaacaagtctaggggagatggagcttcttctgttaagcctgctgagactactagagcaccttctgtgagaagaaccaggtcaaggaagatcgattgatagttaatgaactaagtttgatgtatctgagtgccaacgtttactttgtctttcctttcttttattggttatgattagatgtttactatgttctctctttttcgttataaataaagaagttcaattcttctatagtttcaaacgcgattttaagcgtttctatttaggtttacatgatttcttttacaaaatcatctttaaaatacagtatatttttagttttcataaaatatttaaagaaatgaaagtttataaacattcactcctattctctaattaaggatttgtaaaacaaaaattttgtaagcatatcgatttatgcgttttgtcttaattagctcactaaataataaataatagcttatgttgtgggactgtttaattacctaacttagaactaaaatcaactctttgtgctagctagcctcagctgacgttacgtaacgctaggtagcgtcacgtgacgttagctaacgctaggtagcgtcagctgagcttacgtaagcgcttaattaaagtactgatatcggtaccaaatcgaatccaaaaattacggatatgaatataggcatatccgtatccgaattatccgtttgacagctagcaacgattgtacaattgcttctttaaaaaaggaagaaagaaagaaagaaaagaatcaacatcagcgttaacaaacggccccgttacggcccaaacggtcatatagagtaacggcgttaagcgttgaaagactcctatcgaaatacgtaaccgcaaacgtgtcatagtcagatcccctcttccttcaccgcctcaaacacaaaaataatcttctacagcctatatatacaacccccccttctatctctcctttctcacaattcatcatctttctttctctacccccaattttaagaaatcctctcttctcctcttcattttcaaggtaaatctctctctctctctctctctctgttattccttgttttaattaggtatgtattattgctagtttgttaatctgcttatcttatgtatgccttatgtgaatatctttatcttgttcatctcatccgtttagaagctataaatttgttgatttgactgtgtatctacacgtggttatgtttatatctaatcagatatgaatttcttcatattgttgcgtttgtgtgtaccaatccgaaatcgttgatttttttcatttaatcgtgtagctaattgtacgtatacatatggatctacgtatcaattgttcatctgtttgtgtttgtatgtatacagatctgaaaacatcacttctctcatctgattgtgttgttacatacatagatatagatctgttatatcattttttttattaattgtgtatatatatatgtgcatagatctggattacatgattgtgattatttacatgattttgttatttacgtatgtatatatgtagatctggactttttggagttgttgacttgattgtatttgtgtgtgtatatgtgtgttctgatcttgatatgttatgtatgtgcagctgaaccatggcggcggcaacaacaacaacaacaacatcttcttcgatctccttctccaccaaaccatctccttcctcctccaaatcaccattaccaatctccagattctccctcccattctccctaaaccccaacaaatcatcctcctcctcccgccgccgcggtatcaaatccagctctccctcctccatctccgccgtgctcaacacaaccaccaatgtcacaaccactccctctccaaccaaacctaccaaacccgaaacattcatctcccgattcgctccagatcaaccccgcaaaggcgctgatatcctcgtcgaggctttagaacgtcaaggcgtagaaaccgtattcgcttaccctggaggtacatcaatggagattcaccaagccttaacccgctcttcctcaatccgtaacgtccttcctcgtcacgaacaaggaggtgtattcgcagcagaaggatacgctcgatcctcaggtaaaccaggtatctgtatagccacttcaggtcccggagctacaaatctcgttagcggattagccgatgcgttgttagatagtgttcctcttgtagcaatcacaggacaagtccctcgtcgtatgattggtacagatgcgtttcaagagactccgattgttgaggtaacgcgttcgattacgaagcataactatcttgtgatggatgttgaagatatcccaaggattattgaagaggctttctttttagctacttctggtagacctggacctgttttggttgatgttcctaaagatattcaacaacagcttgcgattcctaattgggaacaggctatgagattacctggttatatgtctaggatgcctaaacctccggaagattctcatttggagcagattgttaggttgatttctgagtctaagaagcctgtgttgtatgttggtggtggttgtcttaattctagcgatgaattgggtaggtttgttgagcttacgggcatccctgttgcgagtacgttgatggggctgggatcttatccttgtgatgatgagttgtcgttacatatgcttggaatgcatgggactgtgtatgcaaattacgctgtggagcatagtgatttgttgttggcgtttggggtaaggtttgatgatcgtgtcacgggtaaacttgaggcttttgctagtagggctaagattgttcatattgatattgactcggctgagattgggaagaataagactcctcatgtgtctgtgtgtggtgatgttaagctggctttgcaagggatgaataaggttcttgagaaccgagcggaggagcttaaacttgattttggagtttggaggaatgagttgaacgtacagaaacagaagtttccgttgagctttaagacgtttggggaagctattcctccacagtatgcgattaaggtccttgatgagttgactgatggaaaagccataataagtactggtgtcgggcaacatcaaatgtgggcggcgcagttctacaattacaagaaaccaaggcagtggctatcatcaggaggccttggagctatgggatttggacttcctgctgcgattggagcgtctgttgctaaccctgatgcgatagttgtggatattgacggagatggaagttttataatgaatgtgcaagagctagccactattcgtgtagagaatcttccagtgaaggtacttttattaaacaaccagcatcttggcatggttatgcaatgggaagatcggttctacaaagctaaccgagctcacacatttctcggggacccggctcaggaggacgagatattcccgaacatgttgctgtttgcagcagcttgcgggattccagcggcgagggtgacaaagaaagcagatctccgagaagctattcagacaatgctggatacaccaggaccttacctgttggatgtgatttgtccgcaccaagaacatgtgttgccgatgatcccgaatggtggcactttcaacgatgtcataacggaaggagatggccggattaaatactgagagatgaaaccggtgattatcagaaccttttatggtctttgtatgcatatggtaaaaaaacttagtttgcaatttcctgtttgttttggtaatttgagtttcttttagttgttgatctgcctgctttttggtttacgtcagactactactgctgttgttgtttggtttcctttctttcattttataaataaataatccggttcggtttactccttgtgactggctcagtttggttattgcgaaatgcgaatggtaaattgagtaattgaaattcgttattagggttctaagctgttttaacagtcactgggttaatatctctcgaatcttgcatggaaaatgctcttaccattggtttttaattgaaatgtgctcatatgggccgtggtttccaaattaaataaaactacgatgtcatcgagaagtaaaatcaactgtgtccacattatcagttttgtgtatacgatgaaatagggtaattcaaaatctagcttgatatgccttttggttcattttaaccttctgtaaacattttttcagattttgaacaagtaaatccaaaaaaaaaaaaaaaaatctcaactcaacactaaattattttaatgtataaaagatgcttaaaacatttggcttaaaagaaagaagctaaaaacatagagaactcttgtaaattgaagtatgaaaatatactgaattgggtattatatgaatttttctgatttaggattcacatgatccaaaaaggaaatccagaagcactaatcagacattggaagtaggattaatcagtgatcagtaactattaaattcaattaaccgcggacatctacatttttgaattgaaaaaaaattggtaattactctttctttttctccatattgaccatcatactcattgctgatccatgtagatttcccggacatgaagccatatatctgaccctactccacaaatatatttttatttataaaaaggtggccattgtatactatgtgtgcgtatacaggaataaaaatgtgtcaatgtatatgtaaactgattccatcttatatgtaatgtgcgtgtgtaaatgaagatactagtatccatgtgtcgcctacttgatttgttcaactgtaactcataatatctcaagattctttcttttttttctacgaatatcgcaatctataataccattaaattattgtaacaaaattggttgacatttataaaatgaaaaagaagagaagagcatttaaacacgactgatgaaagtccaatgtagctagataaaccacgcgtggtggtcaatgcgttccattccaaaaggatccgagttcgaatccgcaccacaccagattttcactgcgcgtggccatgaagctttcgcattctcgctcctgagaatggttctccattttttttttccagtgtagctagataccggtctgaatctaggtttataatatgctgacaatgtaatgataattaatacatcaaaacatgtgtttctgaaccaaaataaaaactttttt

SEQ ID NO: 281 - DNA, 43757 bp, Artificial Sequence
  T-DNA insertion in LBFLFK Locus 1, including left and right border sequences
ccagtcagcatcatcacaccaaaagttaggcccgaatagtttgaaattagaaagctcgcaattgaggtctacaggccaaattcgctcttagccgtacaatattactcaccggtgcgatgccccccatcgtaggtgaaggtggaaattaatggcgcgcctgatcactgattagtaactattacgtaagcctacgtagcgtcacgtgacgttagctaacgctacgtagcctcagctgacgttacgtaagcctacgtagcgtcacgtgagcttagctaacgctacctaggctcagctgacgttacgtaacgctagctagcgtcactcctgcagcaaatttacacattgccactaaacgtctaaacccttgtaatttgtttttgttttactatgtgtgttatgtatttgatttgcgataaatttttatatttggtactaaatttataacaccttttatgctaacgtttgccaacacttagcaatttgcaagttgattaattgattctaaattatttttgtcttctaaatacatatactaatcaactggaaatgtaaatatttgctaatatttctactataggagaattaaagtgagtgaatatggtaccacaaggtttggagatttaattgttgcaatgctgcatggatggcatatacaccaaacattcaataattcttgaggataataatggtaccacacaagatttgaggtgcatgaacgtcacgtggacaaaaggtttagtaatttttcaagacaacaatgttaccacacacaagttttgaggtgcatgcatggatgccctgtggaaagtttaaaaatattttggaaatgatttgcatggaagccatgtgtaaaaccatgacatccacttggaggatgcaataatgaagaaaactacaaatttacatgcaactagttatgcatgtagtctatataatgaggattttgcaatactttcattcatacacactcactaagttttacacgattataatttcttcatagccagtactgtttaagcttcactgtctctgaatcggcaaaggtaaacgtatcaattattctacaaacccttttatttttcttttgaattaccgtcttcattggttatatgataacttgataagtaaagcttcaataattgaatttgatctgtgtttttttggccttaatactaaatccttacataagctttgttgcttctcctcttgtgagttgagtgttaagttgtaataatggttcactttcagctttagaagaaaccatggaagttgttgagaggttctacggagagttggatggaaaggtttcccaaggagtgaacgctttgttgggatctttcggagttgagttgactgataccccaactactaagggattgccactcgttgattctccaactccaattgtgttgggagtgtctgtttacttgaccatcgtgatcggaggattgctttggatcaaggctagagatctcaagccaagagcttctgagccattcttgttgcaagctttggtgttggtgcacaacttgttctgcttcgctttgtctctttacatgtgcgtgggtatcgcttaccaagctatcacctggagatattccttgtggggaaacgcttataacccaaagcacaaggagatggctatcctcgtttacctcttctacatgtccaagtacgtggagttcatggataccgtgatcatgatcctcaagagatccaccagacagatttctttcctccacgtgtaccaccactcttctatctcccttatctggtgggctattgctcaccacgctccaggaggagaggcttattggagtgctgctctcaactctggagtgcacgtgttgatgtacgcttactacttcttggctgcttgcttgagatcttccccaaagctcaagaacaagtacctcttctggggaagatacctcacccaattccagatgttccagttcatgctcaacttggtgcaagcttactacgatatgaaaaccaacgctccatatccacaatggctcatcaagatcctcttctactacatgatctccctcttgttcctcttcggaaacttctacgtgcaaaagtacatcaagccatccgatggaaagcaaaagggagctaagaccgagtgatcgacaagctcgagtttctccataataatgtgtgagtagttcccagataagggaattagggttcctatagggtttcgctcatgtgttgagcatataagaaacccttagtatgtatttgtatttgtaaaatacttctatcaataaaatttctaattcctaaaaccaaaatccagtactaaaatccagatcccccgaattaattcggcgttaattcagctagctagcctcagctgacgttacgtaacgctaggtagcgtcacgtgacgttagctaacgctaggtagcgtcagctgagcttacgtaagcgcttagcagatatttggtgtctaaatgtttattttgtgatatgttcatgtttgaaatggtggtttcgaaaccagggacaacgttgggatctgatagggtgtcaaagagtattatggattgggacaatttcggtcatgagttgcaaattcaagtatatcgttcgattatgaaaattttcgaagaatatcccatttgagagagtctttacctcattaatgtttttagattatgaaattttatcatagttcatcgtagtctttttggtgtaaaggctgtaaaaagaaattgttcacttttgttttcgtttatgtgaaggctgtaaaagattgtaaaagactattttggtgttttggataaaatgatagtttttatagattcttttgcttttagaagaaatacatttgaaattttttccatgttgagtataaaataccgaaatcgattgaagatcatagaaatattttaactgaaaacaaatttataactgattcaattctctccatttttatacctatttaaccgtaatcgattctaatagatgatcgattttttatataatcctaattaaccaacggcatgtattggataattaaccgatcaactctcacccctaatagaatcagtattttccttcgacgttaattgatcctacactatgtaggtcatatccatcgttttaatttttggccaccattcaattctgtcttgcctttagggatgtgaatatgaacggccaaggtaagagaataaaaataatccaaattaaagcaagagaggccaagtaagataatccaaatgtacacttgtcattgccaaaattagtaaaatactcggcatattgtattcccacacattattaaaataccgtatatgtattggctgcatttgcatgaataatactacgtgtaagcccaaaagaacccacgtgtagcccatgcaaagttaacactcacgaccccattcctcagtctccactatataaacccaccatccccaatctcaccaaacccaccacacaactcacaactcactctcacaccttaaagaaccaatcaccaccaaaaaatttcacgatttggaatttgattcctgcgatcacaggtatgacaggttagattttgttttgtatagttgtatacatacttctttgtgatgttttgtttacttaatcgaatttttggagtgttttaaggtctctcgtttagaaatcgtggaaaatatcactgtgtgtgtgttcttatgattcacagtgtttatgggtttcatgttctttgttttatcattgaatgggaagaaatttcgttgggatacaaatttctcatgttcttactgatcgttattaggagtttggggaaaaaggaagagtttttttggttggttcgagtgattatgaggttatttctgtatttgatttatgagttaatggtcgttttaatgttgtagaccatgggaaaaggatctgagggaagatctgctgctagagagatgactgctgaggctaacggagataagagaaagaccatcctcattgagggagtgttgtacgatgctaccaacttcaaacacccaggaggttccattattaacttcctcaccgagggagaagctggagttgatgctacccaagcttacagagagttccatcagagatccggaaaggctgataagtacctcaagtccctcccaaagttggatgcttctaaggtggagtctaggttctctgctaaggagcaggctagaagggacgctatgaccagggattacgctgctttcagagaggagttggttgctgagggatacttcgatccatctatcccacacatgatctacagagtggtggagattgtggctttgttcgctttgtctttctggttgatgtctaaggcttctccaacctctttggttttgggagtggtgatgaacggaatcgctcaaggaagatgcggatgggttatgcacgagatgggacacggatctttcactggagttatctggctcgatgataggatgtgcgagttcttctacggagttggatgtggaatgtctggacactactggaagaaccagcactctaagcaccacgctgctccaaacagattggagcacgatgtggatttgaacaccttgccactcgttgctttcaacgagagagttgtgaggaaggttaagccaggatctttgttggctttgtggctcagagttcaggcttatttgttcgctccagtgtcttgcttgttgatcggattgggatggaccttgtacttgcacccaagatatatgctcaggaccaagagacacatggagtttgtgtggatcttcgctagatatatcggatggttctccttgatgggagctttgggatattctcctggaacttctgtgggaatgtacctctgctctttcggacttggatgcatctacatcttcctccaattcgctgtgtctcacacccacttgccagttaccaacccagaggatcaattgcactggcttgagtacgctgctgatcacaccgtgaacatctctaccaagtcttggttggttacctggtggatgtctaacctcaacttccaaatcgagcaccacttgttcccaaccgctccacaattcaggttcaaggagatctctccaagagttgaggctctcttcaagagacacaacctcccttactacgatttgccatacacctctgctgtttctactaccttcgctaacctctactctgttggacactctgttggagctgataccaagaagcaggattgactgctttaatgagatatgcgagacgcctatgatcgcatgatatttgctttcaattctgttgtgcacgttgtaaaaaacctgagcatgtgtagctcagatccttaccgccggtttcggttcattctaatgaatatatcacccgttactatcgtatttttatgaataatattctccgttcaatttactgattgtctacgtaggctcagctgagcttacctaaggctacgtaggctcacgtgacgttacgtaaggctacgtagcgtcacgtgagcttacctaactctagctagcctcacgtgaccttagctaacactaggtagcgtcagctcgacggcccggactgtatccaacttctgatctttgaatctctctgttccaacatgttctgaaggagttctaagacttttcagaaagcttgtaacatgctttgtagactttctttgaattactcttgcaaactctgattgaacctacgtgaaaactgctccagaagttctaaccaaattccgtcttgggaaggcccaaaatttattgagtacttcagtttcatggacgtgtcttcaaagatttataacttgaaatcccatcatttttaagagaagttctgttccgcaatgtcttagatctcattgaaatctacaactcttgtgtcagaagttcttccagaatcaacttgcatcatggtgaaaatctggccagaagttctgaacttgtcatatttcttaacagttagaaaaatttctaagtgtttagaattttgacttttccaaagcaaacttgacttttgactttcttaataaaacaaacttcatattctaacatgtcttgatgaaatgtgattcttgaaatttgatgttgatgcaaaagtcaaagtttgacttttcagtgtgcaattgaccattttgctcttgtgccaattccaaacctaaattgatgtatcagtgctgcaaacttgatgtcatggaagatcttatgagaaaattcttgaagactgagaggaaaaattttgtagtacaacacaaagaatcctgtttttcatagtcggactagacacattaacataaaacaccacttcattcgaagagtgattgaagaaggaaatgtgcagttacctttctgcagttcataagagcaacttacagacacttttactaaaatactacaaagaggaagattttaacaacttagagaagtaatgggagttaaagagcaacacattaagggggagtgttaaaattaatgtgttgtaaccaccactacctttagtaagtattataagaaaattgtaatcatcacattataattattgtccttatttaaaattatgataaagttgtatcattaagattgagaaaaccaaatagtcctcgtcttgatttttgaattattgttttctatgttacttttcttcaagcctatataaaaactttgtaatgctaaattgtatgctggaaaaaaatgtgtaatgaattgaatagaaattatggtatttcaaagtccaaaatccatcaatagaaatttagtacaaaacgtaactcaaaaatattctcttattttaaattttacaacaatataaaaatattctcttattttaaattttacaataatataatttatcacctgtcacctttagaataccaccaacaatattaatacttagatattttattcttaataattttgagatctctcaatatatctgatatttattttatatttgtgtcatattttcttatgttttagagttaacccttatatcttggtcaaactagtaattcaatatatgagtttgtgaaggacacattgacatcttgaaacattggttttaaccttgttggaatgttaaaggtaataaaacattcagaattatgaccatctattaatatacttcctttgtcttttaaaaaagtgtgcatgaaaatgctctatggtaagctagagtgtcttgctggcctgtgtatatcaattccatttccagatggtagaaactgccactacgaataattagtcataagacacgtatgttaacacacgtccccttgcatgttttttgccatatattccgtctctttctttttcttcacgtataaaacaatgaactaattaatagagcgatcaagctgaacagttctttgctttcgaagttgccgcaacctaaacaggtttttccttcttctttcttcttattaactacgaccttgtcctttgcctatgtaaaattactaggttttcatcagttacactgattaagttcgttatagtggaagataaaatgccctcaaagcattttgcaggatatctttgatttttcaaagatatggaactgtagagtttgatagtgttcttgaatgtggttgcatgaagtttttttggtctgcatgttattttttcctcgaaatatgttttgagtccaacaagtgattcacttgggattcagaaagttgttttctcaatatgtaacagtttttttctatggagaaaaatcatagggaccgttggttttggcttctttaattttgagctcagattaaacccattttacccggtgttcttggcagaattgaaaacagtacgtagtaccgcgcctaccatgtgtgttgagaccgagaacaacgatggaatccctactgtggagatcgctttcgatggagagagagaaagagctgaggctaacgtgaagttgtctgctgagaagatggaacctgctgctttggctaagaccttcgctagaagatacgtggttatcgagggagttgagtacgatgtgaccgatttcaaacatcctggaggaaccgtgattttctacgctctctctaacactggagctgatgctactgaggctttcaaggagttccaccacagatctagaaaggctaggaaggctttggctgctttgccttctagacctgctaagaccgctaaagtggatgatgctgagatgctccaggatttcgctaagtggagaaaggagttggagagggacggattcttcaagccttctcctgctcatgttgcttacagattcgctgagttggctgctatgtacgctttgggaacctacttgatgtacgctagatacgttgtgtcctctgtgttggtttacgcttgcttcttcggagctagatgtggatgggttcaacacgagggaggacactcttctttgaccggaaacatctggtgggataagagaatccaagctttcactgctggattcggattggctggatctggagatatgtggaactccatgcacaacaagcaccacgctactcctcaaaaagtgaggcacgatatggatttggataccactcctgctgttgctttcttcaacaccgctgtggaggataatagacctaggggattctctaagtactggctcagattgcaagcttggaccttcattcctgtgacttctggattggtgttgctcttctggatgttcttcctccacccttctaaggctttgaagggaggaaagtacgaggagcttgtgtggatgttggctgctcacgtgattagaacctggaccattaaggctgttactggattcaccgctatgcaatcctacggactcttcttggctacttcttgggtttccggatgctacttgttcgctcacttctctacttctcacacccacttggatgttgttcctgctgatgagcacttgtcttgggttaggtacgctgtggatcacaccattgatatcgatccttctcagggatgggttaactggttgatgggatacttgaactgccaagtgattcaccacctcttcccttctatgcctcaattcagacaacctgaggtgtccagaagattcgttgctttcgctaagaagtggaacctcaactacaaggtgatgacttatgctggagcttggaaggctactttgggaaacctcgataatgtgggaaagcactactacgtgcacggacaacactctggaaagaccgcttgattaatgaaggccgcctcgaccgtaccccctgcagatagactatactatgttttagcctgcctgctggctagctactatgttatgttatgttgtaaaataaacacctgctaaggtatatctatctatattttagcatggctttctcaataaattgtctttccttatcgtttactatcttatacctaataatgaaataataatatcacatatgaggaacggggcaggtttaggcatatatatacgagtgtagggcggagtggggctacgtagcgtcacgtgacgttacctaagcctaggtagcctcagctgacgttacgtaacgctaggtaggctcagctgacacgggcaggacatagggactactacaagcatagtatgcttcagacaaagagctaggaaagaactcttgatggaggttaagagaaaaaagtgctagaggggcatagtaatcaaacttgtcaaaaccgtcatcatgatgagggatgacataatataaaaagttgactaaggtcttggtagtactctttgattagtattatatattggtgagaacatgagtcaagaggagacaagaaaccgaggaaccatagtttagcaacaagatggaagttgcaaagttgagctagccgctcgattagttacatctcctaagcagtactacaaggaatggtctctatactttcatgtttagcacatggtagtgcggattgacaagttagaaacagtgcttaggagacaaagagtcagtaaaggtattgaaagagtgaagttgatgctcgacaggtcaggagaagtccctccgccagatggtgactaccaaggggttggtatcagctgagacccaaataagattcttcggttgaaccagtggttcgaccgagactcttagggtgggatttcactgtaagatttgtgcattttgttgaatataaattgacaattttttttatttaattatagattatttagaatgaattacatatttagtttctaacaaggatagcaatggatgggtatgggtacaggttaaacatatctattacccacccatctagtcgtcgggttttacacgtacccacccgtttacataaaccagaccggaattttaaaccgtacccgtccgttagcgggtttcagatttacccgtttaatcgggtaaaacctgattactaaatatatattttttatttgataaacaaaacaaaaatgttaatattttcatattggatgcaattttaagaaacacatattcataaatttccatatttgtaggaaaataaaaagaaaaatatattcaagaacacaaatttcaccgacatgacttttattacagagttggaattagatctaacaattgaaaaattaaaattaagatagaatatgttgaggaacatgacatagtataatgctgggttacccgtcgggtaggtatcgaggcggatactactaaatccatcccactcgctatccgataatcactggtttcgggtatacccattcccgtcaacaggcctttttaaccggataatttcaacttatagtgaatgaattttgaataaatagttagaataccaaaatcctggattgcatttgcaatcaaattttgtgaaccgttaaattttgcatgtacttgggatagatataatagaaccgaattttcattagtttaatttataacttactttgttcaaagaaaaaaaatatctatccaatttacttataataaaaaataatctatccaagttacttattataatcaacttgtaaaaaggtaagaatacaaatgtggtagcgtacgtgtgattatatgtgacgaaatgttatatctaacaaaagtccaaattcccatggtaaaaaaaatcaaaatgcatggcaggctgtttgtaaccttggaataagatgttggccaattctggagccgccacgtacgcaagactcagggccacgttctcttcatgcaaggatagtagaacaccactccacccacctcctatattagacctttgcccaaccctccccaactttcccatcccatccacaaagaaaccgacatttttatcataaatctggtgcttaaacactctggtgagttctagtacttctgctatgatcgatctcattaccatttcttaaatttctctccctaaatattccgagttcttgatttttgataacttcaggttttctctttttgataaatctggtctttccattttttttttttgtggttaatttagtttcctatgttcttcgattgtattatgcatgatctgtgtttggattctgttagattatgtattggtgaatatgtatgtgtttttgcatgtctggttttggtcttaaaaatgttcaaatctgatgatttgattgaagcttttttagtgttggtttgattcttctcaaaactactgttaatttactatcatgttttccaactttgattcatgatgacacttttgttctgctttgttataaaattttggttggtttgattttgtaattatagtgtaattttgttaggaatgaacatgttttaatactctgttttcgatttgtcacacattcgaattattaatcgataatttaactgaaaattcatggttctagatcttgttgtcatcagattatttgtttcgataattcatcaaatatgtagtccttttgctgatttgcgactgtttcattttttctcaaaattgttttttgttaagtttatctaacagttatcgttgtcaaaagtctctttcattttgcaaaatcttctttttttttttgtttgtaactttgttttttaagctacacatttagtctgtaaaatagcatcgaggaacagttgtcttagtagacttgcatgttcttgtaacttctatttgtttcagtttgttgatgactgctttgattttgtaggtcaaaggcgcaccctaccatggatgcttataacgctgctatggataagattggagctgctatcatcgattggagtgatccagatggaaagttcagagctgatagggaggattggtggttgtgcgatttcagatccgctatcaccattgctctcatctacatcgctttcgtgatcttgggatctgctgtgatgcaatctctcccagctatggacccataccctatcaagttcctctacaacgtgtctcaaatcttcctctgcgcttacatgactgttgaggctggattcctcgcttataggaacggatacaccgttatgccatgcaaccacttcaacgtgaacgatccaccagttgctaacttgctctggctcttctacatctccaaagtgtgggatttctgggataccatcttcattgtgctcggaaagaagtggagacaactctctttcttgcacgtgtaccaccacaccaccatcttcctcttctactggttgaacgctaacgtgctctacgatggagatatcttcttgaccatcctcctcaacggattcattcacaccgtgatgtacacctactacttcatctgcatgcacaccaaggattctaagaccggaaagtctttgccaatctggtggaagtcatctttgaccgctttccaactcttgcaattcaccatcatgatgtcccaagctacctacttggttttccacggatgcgataaggtttccctcagaatcaccatcgtgtacttcgtgtacattctctcccttttcttcctcttcgctcagttcttcgtgcaatcctacatggctccaaagaagaagaagtccgcttgatgttaatgaaggccgcagatatcagatctggtcgacctagaggatccccggccgcaaagataataacaaaagcctactatataacgtacatgcaagtattgtatgatattaatgtttttacgtacgtgtaaacaaaaataattacgtttgtaacgtatggtgatgatgtggtgcactaggtgtaggccttgtattaataaaaagaagtttgttctatatagagtggtttagtacgacgatttatttactagtcggattggaatagagaaccgaattcttcaatccttgcttttgatcaagaattgaaaccgaatcaaatgtaaaagttgatatatttgaaaaacgtattgagcttatgaaaatgctaatactctcatctgtatggaaaagtgactttaaaaccgaacttaaaagtgacaaaaggggaatatcgcatcaaaccgaatgaaaccgatctacgtaggctcagctgagcttagctaagcctacctagcctcacgtgagattatgtaaggctaggtagcgtcacgtgacgttacctaacactagctagcgtcagctgagcttagctaaccctacgtagcctcacgtgagcttacctaacgctacgtagcctcacgtgactaaggatgacctacccattcttgagacaaatgttacattttagtatcagagtaaaatgtgtacctataactcaaattcgattgacatgtatccattcaacataaaattaaaccagcctgcacctgcatccacatttcaagtattttcaaaccgttcggctcctatccaccgggtgtaacaagacggattccgaatttggaagattttgactcaaattcccaatttatattgaccgtgactaaatcaactttaacttctataattctgattaagctcccaatttatattcccaacggcactacctccaaaatttatagactctcatccccttttaaaccaacttagtaaacgttttttttttaattttatgaagttaagtttttaccttgtttttaaaaagaatcgttcataagatgccatgccagaacattagctacacgttacacatagcatgcagccgcggagaattgtttttcttcgccacttgtcactcccttcaaacacctaagagcttctctctcacagcacacacatacaatcacatgcgtgcatgcattattacacgtgatcgccatgcaaatctcctttatagcctataaattaactcatcggcttcactctttactcaaaccaaaactcatcaatacaaacaagattaaaaacatttcacgatttggaatttgattcctgcgatcacaggtatgacaggttagattttgttttgtatagttgtatacatacttctttgtgatgttttgtttacttaatcgaatttttggagtgttttaaggtctctcgtttagaaatcgtggaaaatatcactgtgtgtgtgttcttatgattcacagtgtttatgggtttcatgttctttgttttatcattgaatgggaagaaatttcgttgggatacaaatttctcatgttcttactgatcgttattaggagtttggggaaaaaggaagagtttttttggttggttcgagtgattatgaggttatttctgtatttgatttatgagttaatggtcgttttaatgttgtagaccgccatggctattttgaaccctgaggctgattctgctgctaacctcgctactgattctgaggctaagcaaagacaattggctgaggctggatacactcacgttgagggtgctcctgctcctttgcctttggagttgcctcacttctctctcagagatctcagagctgctattcctaagcactgcttcgagagatctttcgtgacctccacctactacatgatcaagaacgtgttgacttgcgctgctttgttatacgctgctaccttcattgatagagctggagctgctgcttatgttttgtggcctgtgtactggttcttccagggatcttacttgactggagtgtgggttatcgctcacgagtgtggacaccaggcttattgctcttctgaggtggtgaacaacttgattggactcgtgttgcactctgctttgttggtgccttaccactcttggagaatctctcacagaaagcaccactccaacactggatcttgcgagaacgatgaggttttcgttcctgtgaccagatctgtgttggcttcttcttggaacgagaccttggaggattctcctctctaccaactctaccgtatcgtgtacatgttggttgttggatggatgcctggatacctcttcttcaacgctactggacctactaagtactggggaaagtctaggtctcacttcaacccttactccgctatctatgctgatagggagaggtggatgatcgtgctctccgatattttcttggtggctatgttggctgttttggctgctttggtgcacactttctccttcaacacgatggtgaagttctacgtggtgccttacttcattgtgaacgcttacttggtgttgattacctacctccaacacaccgatacctacatccctcacttcagagagggagagtggaattggttgagaggagctttgtgcactgtggatagatcatttggtccattcctcgattctgtggtgcatagaatcgtggatacccacgtttgccaccatatcttctccaagatgcctttctatcactgcgaggaggctaccaacgctattaagcctctcctcggaaagttctacttgaaggatactactcctgttcctgttgctctctggagatcttacacccactgcaagttcgttgaggatgatggaaaggtggtgttctacaagaacaagttatagttaatgaataattgattggttcgagtattatggcattgggaaaactgtttttcttgtaccatttgttgtgcttgtaatttactgtgttttttattcggttttcgctatcgaactgtgaaatggaaatggatggagaagagttaatgaatgatatggtccttttgttcattctcaaattaatattatttgttttttctcttatttgttgtgtgttgaatttgaaattataagagatatgcaaacattttgttttgagtaaaaatgtgtcaaatcgtggcctctaatgaccgaagttaatatgaggagtaaaacacttgtagttgtaccattatgcttattcactaggcaacaaatatattttcagacctagaaaagctgcaaatgttactgaatacaagtatgtcctcttgtgttttagacatttatgaactttcctttatgtaattttccagaatccttgtcagattctaatcattgctttataattatagttatactcatggatttgtagttgagtatgaaaatattttttaatgcattttatgacttgccaattgattgacaacatgcatcaatctagctagcctcagctgacgttacgtaacgctaggtagcgtcacgtgacgttagctaacgctaggtagcgtcagctgagcttacgtaagcgcacagatgaatactagctgttgttcacagttctagtgtctcctcattacgtgaattcaagctacgatcactatctcaactcctacataaacatcagaatgctacaaaactatgcacaaaaacaaaagctacatctaatacgtgaatcaattactctcatcacaagaaagaagatttcaatcaccgtcgagaaggaggattcagttaattgaatcaaagttccgatcaaactcgaagactggtgagcacgaggacgacgaagaagagtgtctcgaagatacaacaagcaagaaatctactgagtgacctcctgaagttattggcgcgattgagagaatcaatccgaattaatttcggggaaaaagataaattagatactaagcgatgggcttgggctgggctaagaaacaggtggcaattgggctggaggaccccgcgattcatagcttccgatagcccaaaaaaaaacggataacatatttatcgggtatttgaatttcagtgaaataagatattttctttttgttaggaaaattttagaaaataatggaaattaaatagcgattatgttacaagatacgatcagcatcgggcagtgcaaaatgctatagcttcccaagatttgatccttttgggttatctcctaatgacaattagtttaggattttgaaacttatattaatactattatccgacaacacttgtttcagcttcttattttaacattttttgtttttttctattcttcttcccatcagcattttctttttaaaaaattgaatactttaactttttaaaaatttcacaatgatcagatgatattatggaagatctcaagagttaaatgtatccatcttggggcattaaaaccggtgtacgggatgataaatacagactttatatcatatgatagctcagtaattcatatttatcacgttgctaaaaaaattataaggtactagtagtcaacaaaatcaattaaagagaaagaaagaaacgcatgtgaagagagtttacaactggaaaagtaaaataaaaattaacgcatgttgaatgctgacatgtcagtatgtccatgaatccacgtatcaagcgccattcatcgatcgtcttcctctttctaaatgaaaacaacttcacacatcacaacaaacaatacacacaagaccccctctctctcgttgtctctctgccagcgaccaaatcgaagcttgagaagaacaagaaggggtcaaaccatggcttctacatctgctgctcaagacgctgctccttacgagttcccttctctcactgagatcaagagggctcttccttctgagtgtttcgaggcttctgttcctctttctctctactacaccgctagatctcttgctcttgctggatctctcgctgttgctctctcttacgctagagctttgcctcttgttcaggctaacgctcttcttgatgctactctctgcactggatacgttcttctccagggaatcgttttctggggattcttcaccgttggtcacgattgtggacacggagctttctctagatctcacgtgctcaacttctctgttggaaccctcatgcactctatcatccttacccctttcgagtcttggaagctctctcacagacaccaccacaagaacaccggaaacatcgataaggacgagatcttctaccctcaaagagaggctgattctcaccctgtttctagacaccttgtgatgtctcttggatctgcttggttcgcttaccttttcgctggattccctcctagaaccatgaaccacttcaacccttgggaggctatgtatgttagaagagtggctgctgtgatcatctctctcggagttcttttcgctttcgctggactctactcttacctcaccttcgttcttggattcaccactatggctatctactacttcggacctctcttcatcttcgctaccatgcttgttgttaccactttcctccaccacaacgatgaggagacaccttggtacgctgattctgagtggacttacgtgaagggaaacctctcttctgtggacagatcttacggtgctctcatcgacaaccttagccacaacatcggaactcaccagatccaccacctcttccctatcatccctcactacaagctcaacgatgctactgctgctttcgctaaggctttccctgagcttgttaggaaaaacgctgctcctatcatcccaactttcttcaggatggctgctatgtacgctaagtacggagttgttgacactgatgctaagaccttcactctcaaggaggctaaggctgctgctaagactaagtcatcttgatgattaatgaataattgattgtacatactatattttttgtttaccttgtgttagtttaatgttcagtgtcctctctttattgtggcacgtctctttgttgtatgttgtgtctatacaaagttgaaataatggaaagaaaaggaagagtgtaatttgttttgttttaagtgtttataaatatatatatataggtcatttagatagttctaggtttctataaaactctctctctggaagtagaatctgtttttgagaggatccagttgcctactaatctcccccaaaacccttcaagcttaaccttcctcttcacaacaacagaggaaacacatctcttgagctctgagttctcttctttgagcatgtctatcgctaaactcatctgccttatagcttccctcttctcttcatctctctctctcaccatttcgctgtaaaacttattctcctccctcagcctctctatctcttccttcagcatctcacaattcccaccataatcgactgaggatgattcaccgtcatcaacttcagactcagcgttgtagtcgtcatgagtctcacaagccttggaccaagaagactcatcatcgcaagttgatgatttatcatgatgcttctctgagccgtgtttgctacgtagcgtcacgtgacgttacctaagcctaggtagcctcagctgacgttacgtaacgctaggtaggctcagctgactgcagcaaatttacacattgccactaaacgtctaaacccttgtaatttgtttttgttttactatgtgtgttatgtatttgatttgcgataaatttttatatttggtactaaatttataacaccttttatgctaacgtttgccaacacttagcaatttgcaagttgattaattgattctaaattatttttgtcttctaaatacatatactaatcaactggaaatgtaaatatttgctaatatttctactataggagaattaaagtgagtgaatatggtaccacaaggtttggagatttaattgttgcaatgctgcatggatggcatatacaccaaacattcaataattcttgaggataataatggtaccacacaagatttgaggtgcatgaacgtcacgtggacaaaaggtttagtaatttttcaagacaacaatgttaccacacacaagttttgaggtgcatgcatggatgccctgtggaaagtttaaaaatattttggaaatgatttgcatggaagccatgtgtaaaaccatgacatccacttggaggatgcaataatgaagaaaactacaaatttacatgcaactagttatgcatgtagtctatataatgaggattttgcaatactttcattcatacacactcactaagttttacacgattataatttcttcatagccagtactgtttaagcttcactgtctctgaatcggcaaaggtaaacgtatcaattattctacaaacccttttatttttcttttgaattaccgtcttcattggttatatgataacttgataagtaaagcttcaataattgaatttgatctgtgtttttttggccttaatactaaatccttacataagctttgttgcttctcctcttgtgagttgagtgttaagttgtaataatggttcactttcagctttagaagaaacgcgccttccatggctacaaaggaggcttacgttttcccaactctcaccgagatcaagagatctctcccaaaggattgcttcgaggcttctgtgcctttgtctctctactacactgtgagatgcttggttattgctgtggctttgaccttcggattgaactacgctagagctttgccagaggttgagtctttctgggctttggatgctgctttgtgcactggatatatcctcctccagggaattgtgttctggggattcttcactgttggacacgatgctggacacggagctttctctagataccacctcttgaacttcgttgtgggaaccttcatgcactctctcatcttgaccccattcgagtcttggaagttgacccacagacaccaccacaagaacaccggaaacatcgatagagatgaggtgttctacccacagagaaaggctgatgatcacccattgtccaggaacttgatcttggctttgggagctgcttggcttgcttatttggtggagggattcccaccaagaaaggtgaaccacttcaacccattcgagccactttttgtgagacaagtgtccgctgtggttatctctttgctcgctcacttcttcgttgctggactctctatctacttgtctctccagttgggacttaagaccatggctatctactactacggaccagttttcgtgttcggatctatgttggtgattaccaccttcttgcaccacaacgatgaggagactccatggtatgctgattctgagtggacttacgtgaagggaaacttgtcctctgtggatagatcttacggtgctctcatcgataacctctcccacaacatcggaactcaccagatccaccacctcttcccaattatcccacactacaagctcaagaaggctactgctgctttccaccaagctttcccagagcttgtgagaaagtccgatgagccaatcatcaaggctttcttcagagtgggaaggttgtatgctaactacggagtggttgatcaagaggctaagctcttcactttgaaggaggctaaggctgctactgaagctgctgctaagaccaagtctacctgattaatgaatcgacaagctcgagtttctccataataatgtgtgagtagttcccagataagggaattagggttcctatagggtttcgctcatgtgttgagcatataagaaacccttagtatgtatttgtatttgtaaaatacttctatcaataaaatttctaattcctaaaaccaaaatccagtactaaaatccagatcccccgaattaattcggcgttaattcagctacgtaggctcagctgagcttacctaaggctacgtaggctcacgtgacgttacgtaaggctacgtagcgtcacgtgagcttacctaactctagctagcctcacgtgaccttagctaacactaggtagcgtcagcacagatgaatactagctgttgttcacagttctagtgtctcctcattacgtgaattcaagctacgatcactatctcaactcctacataaacatcagaatgctacaaaactatgcacaaaaacaaaagctacatctaatacgtgaatcaattactctcatcacaagaaagaagatttcaatcaccgtcgagaaggaggattcagttaattgaatcaaagttccgatcaaactcgaagactggtgagcacgaggacgacgaagaagagtgtctcgaagatacaacaagcaagaaatctactgagtgacctcctgaagttattggcgcgattgagagaatcaatccgaattaatttcggggaaaaagataaattagatactaagcgatgggcttgggctgggctaagaaacaggtggcaattgggctggaggaccccgcgattcatagcttccgatagcccaaaaaaaaacggataacatatttatcgggtatttgaatttcagtgaaataagatattttctttttgttaggaaaattttagaaaataatggaaattaaatagcgattatgttacaagatacgatcagcatcgggcagtgcaaaatgctatagcttcccaagatttgatccttttgggttatctcctaatgacaattagtttaggattttgaaacttatattaatactattatccgacaacacttgtttcagcttcttattttaacattttttgtttttttctattcttcttcccatcagcattttctttttaaaaaattgaatactttaactttttaaaaatttcacaatgatcagatgatattatggaagatctcaagagttaaatgtatccatcttggggcattaaaaccggtgtacgggatgataaatacagactttatatcatatgatagctcagtaattcatatttatcacgttgctaaaaaaattataaggtactagtagtcaacaaaatcaattaaagagaaagaaagaaacgcatgtgaagagagtttacaactggaaaagtaaaataaaaattaacgcatgttgaatgctgacatgtcagtatgtccatgaatccacgtatcaagcgccattcatcgatcgtcttcctctttctaaatgaaaacaacttcacacatcacaacaaacaatacacacaagaccccctctctctcgttgtctctctgccagcgaccaaatcgaagcttgagaagaacaagaaggggtcaaaccatgggaaaaggatctgagggaagatctgctgctagagagatgactgctgaggctaacggagataagagaaagaccatcctcattgagggagtgttgtacgatgctaccaacttcaaacacccaggaggttccattattaacttcctcaccgagggagaagctggagttgatgctacccaagcttacagagagttccatcagagatccggaaaggctgataagtacctcaagtccctcccaaagttggatgcttctaaggtggagtctaggttctctgctaaggagcaggctagaagggacgctatgaccagggattacgctgctttcagagaggagttggttgctgagggatacttcgatccatctatcccacacatgatctacagagtggtggagattgtggctttgttcgctttgtctttctggttgatgtctaaggcttctccaacctctttggttttgggagtggtgatgaacggaatcgctcaaggaagatgcggatgggttatgcacgagatgggacacggatctttcactggagttatctggctcgatgataggatgtgcgagttcttctacggagttggatgtggaatgtctggacactactggaagaaccagcactctaagcaccacgctgctccaaacagattggagcacgatgtggatttgaacaccttgccactcgttgctttcaacgagagagttgtgaggaaggttaagccaggatctttgttggctttgtggctcagagttcaggcttatttgttcgctccagtgtcttgcttgttgatcggattgggatggaccttgtacttgcacccaagatatatgctcaggaccaagagacacatggagtttgtgtggatcttcgctagatatatcggatggttctccttgatgggagctttgggatattctcctggaacttctgtgggaatgtacctctgctctttcggacttggatgcatctacatcttcctccaattcgctgtgtctcacacccacttgccagttaccaacccagaggatcaattgcactggcttgagtacgctgctgatcacaccgtgaacatctctaccaagtcttggttggttacctggtggatgtctaacctcaacttccaaatcgagcaccacttgttcccaaccgctccacaattcaggttcaaggagatctctccaagagttgaggctctcttcaagagacacaacctcccttactacgatttgccatacacctctgctgtttctactaccttcgctaacctctactctgttggacactctgttggagctgataccaagaagcaggattgatgattaatgaataattgattgtacatactatattttttgtttaccttgtgttagtttaatgttcagtgtcctctctttattgtggcacgtctctttgttgtatgttgtgtctatacaaagttgaaataatggaaagaaaaggaagagtgtaatttgttttgttttaagtgtttataaatatatatatataggtcatttagatagttctaggtttctataaaactctctctctggaagtagaatctgtttttgagaggatccagttgcctactaatctcccccaaaacccttcaagcttaaccttcctcttcacaacaacagaggaaacacatctcttgagctctgagttctcttctttgagcatgtctatcgctaaactcatctgccttatagcttccctcttctcttcatctctctctctcaccatttcgctgtaaaacttattctcctccctcagcctctctatctcttccttcagcatctcacaattcccaccataatcgactgaggatgattcaccgtcatcaacttcagactcagcgttgtagtcgtcatgagtctcacaagccttggaccaagaagactcatcatcgcaagttgatgatttatcatgatgcttctctgagccgtgtttgctacctagagtcagctgagcttagctaacgctagctagtgtcagctgacgttacgtaaggctaactagcgtcacgtgaccttacgtaacgctacgtaggctcagctgagcttagctaaccctagctagtgtcacgtgagcttacgctactatagaaaatgtgttatatcgacatgaccagacaaaggggcaacagttaacaaaacaattaattctttcatttgagattaaggaaggtaaggtactaaaaagattaaaaaaaatgagcttatctctttgtttctgtaataataatataagtgtgataaacttttaatataataattgtaattaggttttctacagatgagcaccactcagagacaagataagaagaaaacaattttgttaaacatgattatagaaacttttagttaagtcttgaagtatcaatataacaaaaaaaagtacacacgactatgacaataaacccactaccgtcaggttatcatttcgatgaaatgttttgatatcattaaatataacagtcacaaaaaatcatctaattataacaatataacttatacatatatttaactaaaaacttagagtttttgtaatgattctaattgatgattagagtttatagaaatacaattaaataaaaaatataattttaaaaaaacatagtaaagtcaatgagatcctctctgacctcagtgatcatttagtcatgtatgtacaacaatcattgttcatcacatgactgtaaaataaataaggataaacttgggaatatatataatatattgtattaaataaaaaagggaaatacaaatatcaattttagattcccgagttgacacaactcaccatgcacgctgccacctcagctcccagctctcgtcacatgtctcatgtcagttaggtctttggtttttagtctttgacacaactcgccatgcatgttgccacgtgagctcgttcctcttcccatgatctcaccactgggcatgcatgctgccacctcagctggcacctcttctctatatgtccctagaggccatgcacagtgccacctcagcactcctctcagaacccatacgtacctgccaatcggcttctctccataaatatctatttaaattataactaattatttcatatacttaattgatgacgtggatgcattgccatcgttgtttaataattgttaattacgacatgataaataaaatgaaagtaaaaagtacgaaagattttccatttgttgttgtataaatagagaagtgagtgatgcataatgcatgaatgcatgaccgcgccaccatgactgttggatacgacgaggagatcccattcgagcaagttagggctcataacaagccagacgacgcttggtgtgctattcacggacacgtgtacgacgttaccaagttcgcttcagttcacccaggaggagatattatcttgctcgctgctggaaaggaagctactgtcctctacgagacctaccatgttagaggagtgtctgacgctgtgctcagaaagtacagaataggaaagttgccagacggacaaggaggagctaacgagaaggagaagagaaccttgtctggattgtcctctgcttcttactacacctggaactccgatttctacagagtgatgagggagagagttgtggctagattgaaggagagaggaaaggctagaagaggaggatacgaactctggatcaaggctttcttgctccttgttggattctggtcctctctttactggatgtgcaccctcgatccatctttcggagctatcttggctgctatgtctttgggagtgttcgctgcttttgttggaacctgcatccaacacgatggaaaccacggagctttcgctcaatctagatgggttaacaaggtggcaggatggactttggatatgatcggagcttctggaatgacttgggagttccaacacgtgttgggacaccacccatacactaacttgatcgaggaggagaacggattgcaaaaggtgtccggaaagaagatggataccaagttggctgatcaagagtctgatccagatgtgttctccacctacccaatgatgagattgcacccttggcaccagaagaggtggtatcacaggttccagcacatctacggacctttcatcttcggattcatgaccatcaacaaggtggtgactcaagatgttggagtggtgttgagaaagagactcttccaaatcgatgctgagtgcagatatgcttccccaatgtacgttgctaggttctggattatgaaggctttgaccgtgttgtatatggttgctttgccttgttatatgcaaggaccttggcacggattgaaactcttcgctatcgctcacttcacttgcggagaggttttggctaccatgttcatcgtgaaccacattatcgagggagtgtcttacgcttctaaggatgctgttaagggaactatggctccaccaaagactatgcacggagtgaccccaatgaacaacactagaaaggaggttgaggctgaggcttctaagtctggagctgtggttaagtctgtgccattggatgattgggctgctgttcagtgccaaacctctgtgaactggtctgttggatcttggttttggaaccacttctctggaggactcaaccaccaaatcgagcaccacctcttcccaggattgtctcacgagacctactaccacatccaagacgtggttcaatctacctgtgctgagtacggagttccataccaacacgagccatctttgtggactgcttactggaagatgctcgaacaccttagacaattgggaaacgaggagactcacgagtcatggcagagagctgcttgattaatgaactaagactcccaaaaccaccttccctgtgacagttaaaccctgcttatacctttcctcctaataatgttcatctgtcacacaaactaaaataaataaaatgggagcaataaataaaatgggagctcatatatttacaccatttacactgtctattattcaccatgccaattattacttcataattttaaaattatgtcatttttaaaaattgcttaatgatggaaaggattattataagttaaaagtataacatagataaactaaccacaaaacaaatcaatataaactaacttactctcccatctaatttttatttaaatttctttacacttctcttccatttctatttctacaacattatttaacatttttattgtatttttcttactttctaactctattcatttcaaaaatcaatatatgtttatcaccacctctctaaaaaaaactttacaatcattggtccagaaaagttaaatcacgagatggtcattttagcattaaaacaacgattcttgtatcactatttttcagcatgtagtccattctcttcaaacaaagacagcggctatataatcgttgtgttatattcagtctaaaacaactagctagcctcagctgacgttacgtaacgctaggtagcgtcacgtgacgttagctaacgctaggtagcgtcagctgagcttacgtaagcgccacgggcaggacatagggactactacaagcatagtatgcttcagacaaagagctaggaaagaactcttgatggaggttaagagaaaaaagtgctagaggggcatagtaatcaaacttgtcaaaaccgtcatcatgatgagggatgacataatataaaaagttgactaaggtcttggtagtactctttgattagtattatatattggtgagaacatgagtcaagaggagacaagaaaccgaggaaccatagtttagcaacaagatggaagttgcaaagttgagctagccgctcgattagttacatctcctaagcagtactacaaggaatggtctctatactttcatgtttagcacatggtagtgcggattgacaagttagaaacagtgcttaggagacaaagagtcagtaaaggtattgaaagagtgaagttgatgctcgacaggtcaggagaagtccctccgccagatggtgactaccaaggggttggtatcagctgagacccaaataagattcttcggttgaaccagtggttcgaccgagactcttagggtgggatttcactgtaagatttgtgcattttgttgaatataaattgacaattttttttatttaattatagattatttagaatgaattacatatttagtttctaacaaggatagcaatggatgggtatgggtacaggttaaacatatctattacccacccatctagtcgtcgggttttacacgtacccacccgtttacataaaccagaacggaattttaaaccgtacccgtccgttagcgggtttcagatttacccgtttaatcgggtaaaacctgattactaaatatatattttttatttgataaacaaaacaaaaatgttaatattttcatattggatgcaattttaagaaacacatattcataaatttccatatttgtaggaaaataaaaagaaaaatatattcaagaacacaaatttcaccgacatgacttttattacagagttggaattagatctaacaattgaaaaattaaaattaagatagaatatgttgaggaacatgacatagtataatgctgggttacccgtcgggtaggtatcgaggcggatactactaaatccatcccactcgctatccgataatcactggtttcgggtatacccattcccgtcaacaggcctttttaaccggataatttcaacttatagtgaatgaattttgaataaatagttagaataccaaaatcctggattgcatttgcaatcaaattttgtgaaccgttaaattttgcatgtacttgggatagatataatagaaccgaattttcattagtttaatttataacttactttgttcaaagaaaaaaaatatctatccaatttacttataataaaaaataatctatccaagttacttattataatcaacttgtaaaaaggtaagaatacaaatgtggtagcgtacgtgtgattatatgtgacgaaatgttatatctaacaaaagtccaaattcccatggtaaaaaaaatcaaaatgcatggcaggctgtttgtaaccttggaataagatgttggccaattctggagccgccacgtacgcaagactcagggccacgttctcttcatgcaaggatagtagaacaccactccacccacctcctatattagacctttgcccaaccctccccaactttcccatcccatccacaaagaaaccgacatttttatcataaatcagggtttcgtttttgtttcatcgataaactcaaaggtgatgattttagggtcttgtgagtgtgcttttttgtttgattctactgtagggtttatgttctttagctcataggttttgtgtatttcttagaaatgtggcttctttaatctctgggtttgtgactttttgtgtggtttctgtgtttttcatatcaaaaacctattttttccgagtttttttttacaaattcttactctcaagcttgaatacttcacatgcagtgttcttttgtagattttagagttaatgtgttaaaaagtttggatttttcttgcttatagagcttcttcactttgattttgtgggtttttttgttttaaaggtgagatttttgatgaggtttttgcttcaaagatgtcacctttctgggtttgtcttttgaataaagctatgaactgtcacatggctgacgcaattttgttactatgtcatgaaagctgacgtttttccgtgttatacatgtttgcttacacttgcatgcgtcaaaaaaattggggctttttagttttagtcaaagattttacttctcttttgggatttatgaaggaaagttgcaaactttctcaaattttaccatttttgctttgatgtttgtttagattgcgacagaacaaactcatatatgttgaaatttttgcttggttttgtataggattgtgtcttttgcttataaatgttgaaatctgaactttttttttgtttggtttctttgagcaggagataaggcgcaccaccatggcttctacatctgctgctcaagacgctgctccttacgagttcccttctctcactgagatcaagagggctcttccttctgagtgtttcgaggcttctgttcctctttctctctactacaccgctagatctcttgctcttgctggatctctcgctgttgctctctcttacgctagagctttgcctcttgttcaggctaacgctcttcttgatgctactctctgcactggatacgttcttctccagggaatcgttttctggggattcttcaccgttggtcacgattgtggacacggagctttctctagatctcacgtgctcaacttctctgttggaaccctcatgcactctatcatccttacccctttcgagtcttggaagctctctcacagacaccaccacaagaacaccggaaacatcgataaggacgagatcttctaccctcaaagagaggctgattctcaccctgtttctagacaccttgtgatgtctcttggatctgcttggttcgcttaccttttcgctggattccctcctagaaccatgaaccacttcaacccttgggaggctatgtatgttagaagagtggctgctgtgatcatctctctcggagttcttttcgctttcgctggactctactcttacctcaccttcgttcttggattcaccactatggctatctactacttcggacctctcttcatcttcgctaccatgcttgttgttaccactttcctccaccacaacgatgaggagacaccttggtacgctgattctgagtggacttacgtgaagggaaacctctcttctgtggacagatcttacggtgctctcatcgacaaccttagccacaacatcggaactcaccagatccaccacctcttccctatcatccctcactacaagctcaacgatgctactgctgctttcgctaaggctttccctgagcttgttaggaaaaacgctgctcctatcatcccaactttcttcaggatggctgctatgtacgctaagtacggagttgttgacactgatgctaagaccttcactctcaaggaggctaaggctgctgctaagactaagtcatcttgatgattaatgaaggccgcagatatcagatctggtcgacctagaggatccccggccgcaaagataataacaaaagcctactatataacgtacatgcaagtattgtatgatattaatgtttttacgtacgtgtaaacaaaaataattacgtttgtaacgtatggtgatgatgtggtgcactaggtgtaggccttgtattaataaaaagaagtttgttctatatagagtggtttagtacgacgatttatttactagtcggattggaatagagaaccgaattcttcaatccttgcttttgatcaagaattgaaaccgaatcaaatgtaaaagttgatatatttgaaaaacgtattgagcttatgaaaatgctaatactctcatctgtatggaaaagtgactttaaaaccgaacttaaaagtgacaaaaggggaatatcgcatcaaaccgaatgaaaccgatctacgtaggctcagctgagcttacctaaggctacgtaggctcacgtgacgttacgtaaggctacgtagcgtcacgtgagcttacctaactctagctagcctcacgtgaccttagctaacactaggtagcgtcagcttagcagatatttggtgtctaaatgtttattttgtgatatgttcatgtttgaaatggtggtttcgaaaccagggacaacgttgggatctgatagggtgtcaaagagtattatggattgggacaatttcggtcatgagttgcaaattcaagtatatcgttcgattatgaaaattttcgaagaatatcccatttgagagagtctttacctcattaatgtttttagattatgaaattttatcatagttcatcgtagtctttttggtgtaaaggctgtaaaaagaaattgttcacttttgttttcgtttatgtgaaggctgtaaaagattgtaaaagactattttggtgttttggataaaatgatagtttttatagattcttttgcttttagaagaaatacatttgaaattttttccatgttgagtataaaataccgaaatcgattgaagatcatagaaatattttaactgaaaacaaatttataactgattcaattctctccatttttatacctatttaaccgtaatcgattctaatagatgatcgattttttatataatcctaattaaccaacggcatgtattggataattaaccgatcaactctcacccctaatagaatcagtattttccttcgacgttaattgatcctacactatgtaggtcatatccatcgttttaatttttggccaccattcaattctgtcttgcctttagggatgtgaatatgaacggccaaggtaagagaataaaaataatccaaattaaagcaagagaggccaagtaagataatccaaatgtacacttgtcattgccaaaattagtaaaatactcggcatattgtattcccacacattattaaaataccgtatatgtattggctgcatttgcatgaataatactacgtgtaagcccaaaagaacccacgtgtagcccatgcaaagttaacactcacgaccccattcctcagtctccactatataaacccaccatccccaatctcaccaaacccaccacacaactcacaactcactctcacaccttaaagaaccaatcaccaccaaaaaaagttctttgctttcgaagttgccgcaacctaaacaggtttttccttcttctttcttcttattaactacgaccttgtcctttgcctatgtaaaattactaggttttcatcagttacactgattaagttcgttatagtggaagataaaatgccctcaaagcattttgcaggatatctttgatttttcaaagatatggaactgtagagtttgatagtgttcttgaatgtggttgcatgaagtttttttggtctgcatgttattttttcctcgaaatatgttttgagtccaacaagtgattcacttgggattcagaaagttgttttctcaatatgtaacagtttttttctatggagaaaaatcatagggaccgttggttttggcttctttaattttgagctcagattaaacccattttacccggtgttcttggcagaattgaaaacagtacgtagtaccgcgcctaccatgccacctagtgctgctagtgaaggtggtgttgctgaacttagagctgctgaagttgctagctacactagaaaggctgttgacgaaagacctgacctcactatagttggtgacgctgtttacgacgctaaggcttttagggacgagcaccctggtggtgctcacttcgttagccttttcggaggtagggacgctactgaggcttttatggaatatcaccgtagagcttggcctaaggctaggatgtctaagttcttcgttggttcacttgacgctagcgagaagcctactcaagctgattcagcttaccttagactttgcgctgaggttaacgctcttttgcctaagggtagcggaggattcgctcctcctagctactggcttaaggctgctgctcttgttgttgctgctgttagtatagagggttatatgctccttaggggtaagacccttttgcttagcgttttccttggactcgtgttcgcttggataggacttaatattcagcacgacgctaatcacggtgctcttagtagacactcagtgattaactactgcctcggttacgctcaggattggataggtggtaatatggtgctttggcttcaagagcacgttgtgatgcaccacctccacactaacgacgttgacgctgatcctgatcaaaaggctcacggtgttcttagacttaagcctactgacggttggatgccttggcacgcacttcaacaactctatatccttcctggtgaggctatgtacgcttttaagcttcttttcttggacgcccttgagcttcttgcttggaggtgggagggtgagaagattagccctcttgctagagctttgttcgctcctgctgttgcttgtaagcttggattctgggctagattcgttgctctccctctctggcttcaacctactgttcacactgctttgtgtatctgtgctactgtgtgtactggtagcttctacctcgccttcttcttctttatctctcacaacttcgacggtgttggtagcgttggacctaagggatcacttcctagatcagctactttcgttcaacgtcaggttgagactagctctaacgttggtggttactggcttggagttcttaacggtggacttaactttcagatagagcaccacttgttccctaggcttcaccactcttactacgctcaaatagctcctgtggttaggactcacatagagaagctcggttttaagtaccgtcacttccctaccgttggatctaaccttagctcaatgcttcagcatatgggtaagatgggaactagacctggtgctgagaagggtggtaaggctgagtagtgattaatgaataattgattgctgctttaatgagatatgcgagacgcctatgatcgcatgatatttgctttcaattctgttgtgcacgttgtaaaaaacctgagcatgtgtagctcagatccttaccgccggtttcggttcattctaatgaatatatcacccgttactatcgtatttttatgaataatattctccgttcaatttactgattgtctacgtagcgtcacctgacgttacgtaaggctacctaggctcacgtgacgttacgtaacgctacgtagcgtcaggtgaggttagctaacgctagctagcctcacctgacgttaggtaaggctacgtagcgtcacctgagattagctaagcctacctagactcacgtgaccttaggtaacgctacgtagcgtcaaagctttacaacgctacacaaaacttataaccgtaatcaccattcattaacttaactactatcacatgcattcatgaattgaaacgagaaggatgtaaatagttgggaagttatctccacgttgaagagatcgttagcgagagctgaaagaccgagggaggagacgccgtcaacacggacagagtcgtcgaccctcacatgaagtaggaggaatctccgtgaggagccagagagacgtctttggtcttcggtttcgatccttgatctgacggagaagacgagagaagtgcgactggactccgtgaggaccaacagagtcgtcctcggtttcgatcgtcggtattggtggagaaggcggaggaatctccgtgacgagccagagagatgtcgtcggtcttcggtttcgatccttgatctgacggagaagacgagagaagtgcgacgagactccgtgaggaccaacagagttgtcctcggtttcgatcgtcggtttcggcggagaaggcggaggaatctccgtgaggagccagagagacgtcgttggtcttcggtttcgatccttgatctgttggagaagacgagacaagtgggacgagactcaacgacggagtcagagacgtcgtcggtcttcggtttcggccgagaaggcggagtcggtcttcggtttcggccgagaaggcggaggagacgtcttcgatttgggtctctcctcttgacgaagaaaacaaagaacacgagaaataatgagaaagagaacaaaagaaaaaaaaataaaaataaaaataaaatttggtcctcttatgtggtgacacgtggtttgaaacccaccaaataatcgatcacaaaaaacctaagttaaggatcggtaataacctttctaattaattttgatttatattaaatcactctttttatttataaaccccactaaattatgcgatattgattgtctaagtacaaaaattctctcgaattcaatacacatgtttcatatatttagccctgttcatttaatattactagcgcatttttaatttaaaattttgtaaacttttttggtcaaagaacatttttttaattagagacagaaatctagactctttatttggaataatagtaataaagatatattaggcaatgagtttatgatgttatgtttatatagtttatttcattttaaattgaaaagcattatttttatcgaaatgaatctagtatacaatcaatatttatgttttttcatcagatactttcctattttttggcacctttcatcggactactgatttatttcaatgtgtatgcatgcatgagcatgagtatacacatgtcttttaaaatgcatgtaaagcgtaacggaccacaaaagaggatccatacaaatacatctcatcgcttcctctactattctccgacacacacactgagcatggtgcttaaacactctggtgagttctagtacttctgctatgatcgatctcattaccatttcttaaatttctctccctaaatattccgagttcttgatttttgataacttcaggttttctctttttgataaatctggtctttccatttttttttttttgtggttaatttagtttcctatgttcttcgattgtattatgcatgatctgtgtttggattctgttagattatgtattggtgaatatgtatgtgtttttgcatgtctggttttggtcttaaaaatgttcaaatctgatgatttgattgaagcttttttagtgttggtttgattcttctcaaaactactgttaatttactatcatgttttccaactttgattcatgatgacacttttgttctgctttgttataaaattttggttggtttgattttgtaattatagtgtaattttgttaggaatgaacatgttttaatactctgttttcgatttgtcacacattcgaattattaatcgataatttaactgaaaattcatggttctagatcttgttgtcatcagattatttgtttcgataattcatcaaatatgtagtccttttgctgatttgcgactgtttcattttttctcaaaattgttttttgttaagtttatctaacagttatcgttgtcaaaagtctctttcattttgcaaaatcttctttttttttttgtttgtaactttgttttttaagctacacatttagtctgtaaaatagcatcgaggaacagttgtcttagtagacttgcatgttcttgtaacttctatttgtttcagtttgttgatgactgctttgattttgtaggtcaaaccgcgccatgtctgctagcggagctttgttgcctgctatagctttcgctgcttacgcttacgctacctacgcttatgctttcgagtggagccacgctaacggaatcgataacgtggatgctagagagtggattggagctttgtctttgagactccctgcaattgcaaccacaatgtacctcttgttctgccttgtgggacctagattgatggctaagagggaggcttttgatcctaagggatttatgctcgcttacaacgcttaccaaaccgctttcaacgttgtggtgctcggaatgttcgctagagagatctctggattgggacaacctgtttggggatctactatgccttggagcgataggaagtccttcaagattttgttgggagtgtggctccactacaacaataagtacctcgagttgttggatactgtgttcatggtggctaggaaaaagaccaagcagctctctttcttgcacgtgtaccaccacgctttgttgatttgggcttggtggcttgtttgtcacctcatggctaccaacgattgcatcgatgcttatttcggagctgcttgcaactctttcatccacatcgtgatgtactcctactacctcatgtctgctttgggaattaggtgcccttggaagagatatatcacccaggctcagatgttgcaattcgtgatcgtgttcgctcacgctgttttcgtgctcagacaaaagcactgccctgttactttgccttgggcacaaatgttcgtgatgacaaatatgttggtgctcttcggaaacttctacctcaaggcttactctaacaagtctaggggagatggagcttcttctgttaagcctgctgagactactagagcaccttctgtgagaagaaccaggtcaaggaagatcgattgatagttaatgaactaagtttgatgtatctgagtgccaacgtttactttgtctttcctttcttttattggttatgattagatgtttactatgttctctctttttcgttataaataaagaagttcaattcttctatagtttcaaacgcgattttaagcgtttctatttaggtttacatgatttcttttacaaaatcatctttaaaatacagtatatttttagttttcataaaatatttaaagaaatgaaagtttataaacattcactcctattctctaattaaggatttgtaaaacaaaaattttgtaagcatatcgatttatgcgttttgtcttaattagctcactaaataataaataatagcttatgttgtgggactgtttaattacctaacttagaactaaaatcaactctttgtgctagctagcctcagctgacgttacgtaacgctaggtagcgtcacgtgacgttagctaacgctaggtagcgtcagctgagcttacgtaagcgcttaattaaagtactgatatcggtaccaaatcgaatccaaaaattacggatatgaatataggcatatccgtatccgaattatccgtttgacagctagcaacgattgtacaattgcttctttaaaaaaggaagaaagaaagaaagaaaagaatcaacatcagcgttaacaaacggccccgttacggcccaaacggtcatatagagtaacggcgttaagcgttgaaagactcctatcgaaatacgtaaccgcaaacgtgtcatagtcagatcccctcttccttcaccgcctcaaacacaaaaataatcttctacagcctatatatacaacccccccttctatctctcctttctcacaattcatcatctttctttctctacccccaattttaagaaatcctctcttctcctcttcattttcaaggtaaatctctctctctctctctctctctgttattccttgttttaattaggtatgtattattgctagtttgttaatctgcttatcttatgtatgccttatgtgaatatctttatcttgttcatctcatccgtttagaagctataaatttgttgatttgactgtgtatctacacgtggttatgtttatatctaatcagatatgaatttcttcatattgttgcgtttgtgtgtaccaatccgaaatcgttgatttttttcatttaatcgtgtagctaattgtacgtatacatatggatctacgtatcaattgttcatctgtttgtgtttgtatgtatacagatctgaaaacatcacttctctcatctgattgtgttgttacatacatagatatagatctgttatatcattttttttattaattgtgtatatatatatgtgcatagatctggattacatgattgtgattatttacatgattttgttatttacgtatgtatatatgtagatctggactttttggagttgttgacttgattgtatttgtgtgtgtatatgtgtgttctgatcttgatatgttatgtatgtgcagctgaaccatggcggcggcaacaacaacaacaacaacatcttcttcgatctccttctccaccaaaccatctccttcctcctccaaatcaccattaccaatctccagattctccctcccattctccctaaaccccaacaaatcatcctcctcctcccgccgccgcggtatcaaatccagctctccctcctccatctccgccgtgctcaacacaaccaccaatgtcacaaccactccctctccaaccaaacctaccaaacccgaaacattcatctcccgattcgctccagatcaaccccgcaaaggcgctgatatcctcgtcgaggctttagaacgtcaaggcgtagaaaccgtattcgcttaccctggaggtacatcaatggagattcaccaagccttaacccgctcttcctcaatccgtaacgtccttcctcgtcacgaacaaggaggtgtattcgcagcagaaggatacgctcgatcctcaggtaaaccaggtatctgtatagccacttcaggtcccggagctacaaatctcgttagcggattagccgatgcgttgttagatagtgttcctcttgtagcaatcacaggacaagtccctcgtcgtatgattggtacagatgcgtttcaagagactccgattgttgaggtaacgcgttcgattacgaagcataactatcttgtgatggatgttgaagatatcccaaggattattgaagaggctttctttttagctacttctggtagacctggacctgttttggttgatgttcctaaagatattcaacaacagcttgcgattcctaattgggaacaggctatgagattacctggttatatgtctaggatgcctaaacctccggaagattctcatttggagcagattgttaggttgatttctgagtctaagaagcctgtgttgtatgttggtggtggttgtcttaattctagcgatgaattgggtaggtttgttgagcttacgggcatccctgttgcgagtacgttgatggggctgggatcttatccttgtgatgatgagttgtcgttacatatgcttggaatgcatgggactgtgtatgcaaattacgctgtggagcatagtgatttgttgttggcgtttggggtaaggtttgatgatcgtgtcacgggtaaacttgaggcttttgctagtagggctaagattgttcatattgatattgactcggctgagattgggaagaataagactcctcatgtgtctgtgtgtggtgatgttaagctggctttgcaagggatgaataaggttcttgagaaccgagcggaggagcttaaacttgattttggagtttggaggaatgagttgaacgtacagaaacagaagtttccgttgagctttaagacgtttggggaagctattcctccacagtatgcgattaaggtccttgatgagttgactgatggaaaagccataataagtactggtgtcgggcaacatcaaatgtgggcggcgcagttctacaattacaagaaaccaaggcagtggctatcatcaggaggccttggagctatgggatttggacttcctgctgcgattggagcgtctgttgctaaccctgatgcgatagttgtggatattgacggagatggaagttttataatgaatgtgcaagagctagccactattcgtgtagagaatcttccagtgaaggtacttttattaaacaaccagcatcttggcatggttatgcaatgggaagatcggttctacaaagctaaccgagctcacacatttctcggggacccggctcaggaggacgagatattcccgaacatgttgctgtttgcagcagcttgcgggattccagcggcgagggtgacaaagaaagcagatctccgagaagctattcagacaatgctggatacaccaggaccttacctgttggatgtgatttgtccgcaccaagaacatgtgttgccgatgatcccgaatggtggcactttcaacgatgtcataacggaaggagatggccggattaaatactgagagatgaaaccggtgattatcagaaccttttatggtctttgtatgcatatggtaaaaaaacttagtttgcaatttcctgtttgttttggtaatttgagtttcttttagttgttgatctgcctgctttttggtttacgtcagactactactgctgttgttgtttggtttcctttctttcattttataaataaataatccggttcggtttactccttgtgactggctcagtttggttattgcgaaatgcgaatggtaaattgagtaattgaaattcgttattagggttctaagctgttttaacagtcactgggttaatatctctcgaatcttgcatggaaaatgctcttaccattggtttttaattgaaatgtgctcatatgggccgtggtttccaaattaaataaaactacgatgtcatcgagaagtaaaatcaactgtgtccacattatcagttttgtgtatacgatgaaatagggtaattcaaaatctagcttgatatgccttttggttcattttaaccttctgtaaacattttttcagattttgaacaagtaaatccaaaaaaaaaaaaaaaaatctcaactcaacactaaattattttaatgtataaaagatgcttaaaacatttggcttaaaagaaagaagctaaaaacatagagaactcttgtaaattgaagtatgaaaatatactgaattgggtattatatgaatttttctgatttaggattcacatgatccaaaaaggaaatccagaagcactaatcagacattggaagtaggattaatcagtgatcagtaactattaaattcaattaaccgcggacatctacatttttgaattgaaaaaaaattggtaattactctttctttttctccatattgaccatcatactcattgctgatccatgtagatttcccggacatgaagccatata

SEQ ID NO: 282 - DNA, 20 bp, Artificial sequence
  LBFLFK Locus 1 RB junction region
agctcgcaatccagtcagca

SEQ ID NO: 283 - DNA, 20 bp, Artificial sequence
  LBFLFK Locus 1 LB junction region
aagccatatatctgacccta

SEQ ID NO: 284 - DNA, 1100 bp, Artificial sequence; identical to SEQ ID NO: 228
  LBFLFK Locus 1 flanking sequence up to and including the right border of the T-DNA

SEQ ID NO: 285 - DNA, 811 bp, Artificial sequence; identical to SEQ ID NO: 229
  LBFLFK Locus 1 flanking sequence up to and including the left border of the T-DNA

SEQ ID NO: 286 - DNA, 27 bp, Artificial sequence
  LBFLFK Locus 1_Forward primer
ctctttctttttctccatattgaccat

SEQ ID NO: 287 - DNA, 28 bp, Artificial sequence
  LBFLFK Locus 1_Reverse primer
acatttttattcctgtatacgcacacat

SEQ ID NO: 288 - DNA, 19 bp, Artificial sequence
  LBFLFK locus 1_Probe
atactcattgctgatccat

SEQ ID NO: 289 - DNA, 47800 bp, Artificial sequence
  contig of insert and flanking sequences of LBFLFK T-DNA Locus 2
gaaaaacctgcatctccaaaaatgttcaaatggcttaaaaacagagaaaatgagtggaatattagatagatctacctttatagaacacacaaaaatacatatctaaaattattaaatcttcctttaaatgagtggaagatgagaaccatgtgatgaaaaacctgcaaaacaagataaattagtaagaaaaacatgagacagaaacaataaattgatataaagtttgatgtttataagttcaaagggattaaagagaggtttgagagttttagaacgaggaacataccatttttgttgcagccatttgagaggagaagagagaatgtgtaaatgtttttttatataaggagacaaaaattccaataaggttaaatatttttgatcagaagacttactagacgacttacttgtaagtcgcccagaagacttcaatatttttagcgggaaactaaaatatttttagcgggagttagaagaccctaaacataacccttaaactaaattaactaactaaatacttcataaaatcaaattaaacttaaaaagtgtttactatacacagaaataatcacatgtagatataaatttaatttttcaaaaaaacatttaagctttccaaaatctaaccctaagaatacatacaatactacaacatatgttgccaaaccctagaccaaagaatatcatgattcactactttcactcatctatgttgaaaacaattcaattttattatatcttaatttatatcacttaaaactgtttataattacatgattttaattttccgtttatcaaaatattttttacaaaatttataaattatttttaggatcaactataccagacgacttccatggacgccgtacagaagactaaacagaatctcacaagactcagaagacgtagcggggatatattcataaaaatgagttctgtttttttgtttggtcacaaggggctggttgtaatttcacaaggcttttggattacttttgcatttgattcaagtttgggtatacttttgcaatcaaaatcaagttttgagtcatatttggtaaatcgccctatataaaataaaattttaaaaagtaatgaatctacatattttgtaatttttaaaaaatttagttaacaattataataacacaaaacttaagaaaaagttataattgtcgtatttttttctcttttcttttctatgtaatatttttatataagtaataatgtgaatagaatttatcaaatcatatgttagaataattattatataattttatacatttaaaaatttaaatataatcaagatatatacatgtatttatatattaccagatcagagcagatatccgtttcccaaaattttaatatttgtgatttgcttcgattttaatggatattgatttttagtatttttttgcttcaaaagtttatggatattcggaattttcggatcgaatcgaaacgaataacgcatcaaatcaaatttaacggataaaaccttagtaacacatgcataaaccttagtgaacttctcaagctttcgattctctatcttatttatctatgaaattaattaacataattttccttgaattaacataattggactaacgcatattcgagctgaagtcaaaattcccaaaacttgttcttgatatgagtaaaactgttcgtctgatgtaaactcttactgtagttgtattacaaactaatgataaagtatgcattttctattttattataaatttacattactagttgataacatattgacaactagaaagcgtgagagagagatactcggtaagccgagatgtatatccacagttggagtctttggatttcatatccagaattgggtcgcaaactttcagtacaaagttatgacatctccatggtatatatcgacgtgtctatatatcatattaaagaaaggtttgtagtatttggttaggtacaaatgcgatcaacttttgaatttatatccatgtacatatatacccttggttacaaggacacctacccatacatacgcataagtgacaaatagcaaaatatctacacatcgcatgaccccgttcttttttatgataaggttgtgatttttgtggttcttttttttcatctcttacattgattcagtatgttgtccaaaaaaaaaacagtgattcagtattatatcgagtaaattcacaagaacgtagctacaatgtagatgatttattaacaattttacaagagacaagcaaatgtcgagcaatcatattctataatatcaacctaaaagagttaaatccataaaattagttggcaacgagcgatagtatgaaagttaggtgatgacaaaagttgctatattgcttcaactatattttcataaatttatttgtctggatgaaaaccacaaaattttaaaaatataattttgattggtaatatgtaaataacgggatcctatatttaaaccagtcagcatcatcacaccaaaagttaggcccgaatagtttgaaattagaaagctcgcaattgaggtctacaggccaaattcgctcttagccgtacaatattactcaccggtgcgatgccccccatcgtaggtgaaggtggaaattaatggcgcgcctgatcactgattagtaactattacgtaagcctacgtagcgtcacgtgacgttagctaacgctacgtagcctcagctgacgttacgtaagcctacgtagcgtcacgtgagcttagctaacgctacctaggctcagctgacgttacgtaacgctagctagcgtcactcctgcagcaaatttacacattgccactaaacgtctaaacccttgtaatttgtttttgttttactatgtgtgttatgtatttgatttgcgataaatttttatatttggtactaaatttataacaccttttatgctaacgtttgccaacacttagcaatttgcaagttgattaattgattctaaattatttttgtcttctaaatacatatactaatcaactggaaatgtaaatatttgctaatatttctactataggagaattaaagtgagtgaatatggtaccacaaggtttggagatttaattgttgcaatgctgcatggatggcatatacaccaaacattcaataattcttgaggataataatggtaccacacaagatttgaggtgcatgaacgtcacgtggacaaaaggtttagtaatttttcaagacaacaatgttaccacacacaagttttgaggtgcatgcatggatgccctgtggaaagtttaaaaatattttggaaatgatttgcatggaagccatgtgtaaaaccatgacatccacttggaggatgcaataatgaagaaaactacaaatttacatgcaactagttatgcatgtagtctatataatgaggattttgcaatactttcattcatacacactcactaagttttacacgattataatttcttcatagccagtactgtttaagcttcactgtctctgaatcggcaaaggtaaacgtatcaattattctacaaacccttttatttttcttttgaattaccgtcttcattggttatatgataacttgataagtaaagcttcaataattgaatttgatctgtgtttttttggccttaatactaaatccttacataagctttgttgcttctcctcttgtgagttgagtgttaagttgtaataatggttcactttcagctttagaagaaaccatggaagttgttgagaggttctacggagagttggatggaaaggtttcccaaggagtgaacgctttgttgggatctttcggagttgagttgactgataccccaactactaagggattgccactcgttgattctccaactccaattgtgttgggagtgtctgtttacttgaccatcgtgatcggaggattgctttggatcaaggctagagatctcaagccaagagcttctgagccattcttgttgcaagctttggtgttggtgcacaacttgttctgcttcgctttgtctctttacatgtgcgtgggtatcgcttaccaagctatcacctggagatattccttgtggggaaacgcttataacccaaagcacaaggagatggctatcctcgtttacctcttctacatgtccaagtacgtggagttcatggataccgtgatcatgatcctcaagagatccaccagacagatttctttcctccacgtgtaccaccactcttctatctcccttatctggtgggctattgctcaccacgctccaggaggagaggcttattggagtgctgctctcaactctggagtgcacgtgttgatgtacgcttactacttcttggctgcttgcttgagatcttccccaaagctcaagaacaagtacctcttctggggaagatacctcacccaattccagatgttccagttcatgctcaacttggtgcaagcttactacgatatgaaaaccaacgctccatatccacaatggctcatcaagatcctcttctactacatgatctccctcttgttcctcttcggaaacttctacgtgcaaaagtacatcaagccatccgatggaaagcaaaagggagctaagaccgagtgatcgacaagctcgagtttctccataataatgtgtgagtagttcccagataagggaattagggttcctatagggtttcgctcatgtgttgagcatataagaaacccttagtatgtatttgtatttgtaaaatacttctatcaataaaatttctaattcctaaaaccaaaatccagtactaaaatccagatcccccgaattaattcggcgttaattcagctagctagcctcagctgacgttacgtaacgctaggtagcgtcacgtgacgttagctaacgctaggtagcgtcagctgagcttacgtaagcgcttagcagatatttggtgtctaaatgtttattttgtgatatgttcatgtttgaaatggtggtttcgaaaccagggacaacgttgggatctgatagggtgtcaaagagtattatggattgggacaatttcggtcatgagttgcaaattcaagtatatcgttcgattatgaaaattttcgaagaatatcccatttgagagagtctttacctcattaatgtttttagattatgaaattttatcatagttcatcgtagtctttttggtgtaaaggctgtaaaaagaaattgttcacttttgttttcgtttatgtgaaggctgtaaaagattgtaaaagactattttggtgttttggataaaatgatagtttttatagattcttttgcttttagaagaaatacatttgaaattttttccatgttgagtataaaataccgaaatcgattgaagatcatagaaatattttaactgaaaacaaatttataactgattcaattctctccatttttatacctatttaaccgtaatcgattctaatagatgatcgattttttatataatcctaattaaccaacggcatgtattggataattaaccgatcaactctcacccctaatagaatcagtattttccttcgacgttaattgatcctacactatgtaggtcatatccatcgttttaatttttggccaccattcaattctgtcttgcctttagggatgtgaatatgaacggccaaggtaagagaataaaaataatccaaattaaagcaagagaggccaagtaagataatccaaatgtacacttgtcattgccaaaattagtaaaatactcggcatattgtattcccacacattattaaaataccgtatatgtattggctgcatttgcatgaataatactacgtgtaagcccaaaagaacccacgtgtagcccatgcaaagttaacactcacgaccccattcctcagtctccactatataaacccaccatccccaatctcaccaaacccaccacacaactcacaactcactctcacaccttaaagaaccaatcaccaccaaaaaatttcacgatttggaatttgattcctgcgatcacaggtatgacaggttagattttgttttgtatagttgtatacatacttctttgtgatgttttgtttacttaatcgaatttttggagtgttttaaggtctctcgtttagaaatcgtggaaaatatcactgtgtgtgtgttcttatgattcacagtgtttatgggtttcatgttctttgttttatcattgaatgggaagaaatttcgttgggatacaaatttctcatgttcttactgatcgttattaggagtttggggaaaaaggaagagtttttttggttggttcgagtgattatgaggttatttctgtatttgatttatgagttaatggtcgttttaatgttgtagaccatgggaaaaggatctgagggaagatctgctgctagagagatgactgctgaggctaacggagataagagaaagaccatcctcattgagggagtgttgtacgatgctaccaacttcaaacacccaggaggttccattattaacttcctcaccgagggagaagctggagttgatgctacccaagcttacagagagttccatcagagatccggaaaggctgataagtacctcaagtccctcccaaagttggatgcttctaaggtggagtctaggttctctgctaaggagcaggctagaagggacgctatgaccagggattacgctgctttcagagaggagttggttgctgagggatacttcgatccatctatcccacacatgatctacagagtggtggagattgtggctttgttcgctttgtctttctggttgatgtctaaggcttctccaacctctttggttttgggagtggtgatgaacggaatcgctcaaggaagatgcggatgggttatgcacgagatgggacacggatctttcactggagttatctggctcgatgataggatgtgcgagttcttctacggagttggatgtggaatgtctggacactactggaagaaccagcactctaagcaccacgctgctccaaacagattggagcacgatgtggatttgaacaccttgccactcgttgctttcaacgagagagttgtgaggaaggttaagccaggatctttgttggctttgtggctcagagttcaggcttatttgttcgctccagtgtcttgcttgttgatcggattgggatggaccttgtacttgcacccaagatatatgctcaggaccaagagacacatggagtttgtgtggatcttcgctagatatatcggatggttctccttgatgggagctttgggatattctcctggaacttctgtgggaatgtacctctgctctttcggacttggatgcatctacatcttcctccaattcgctgtgtctcacacccacttgccagttaccaacccagaggatcaattgcactggcttgagtacgctgctgatcacaccgtgaacatctctaccaagtcttggttggttacctggtggatgtctaacctcaacttccaaatcgagcaccacttgttcccaaccgctccacaattcaggttcaaggagatctctccaagagttgaggctctcttcaagagacacaacctcccttactacgatttgccatacacctctgctgtttctactaccttcgctaacctctactctgttggacactctgttggagctgataccaagaagcaggattgactgctttaatgagatatgcgagacgcctatgatcgcatgatatttgctttcaattctgttgtgcacgttgtaaaaaacctgagcatgtgtagctcagatccttaccgccggtttcggttcattctaatgaatatatcacccgttactatcgtatttttatgaataatattctccgttcaatttactgattgtctacgtaggctcagctgagcttacctaaggctacgtaggctcacgtgacgttacgtaaggctacgtagcgtcacgtgagcttacctaactctagctagcctcacgtgaccttagctaacactaggtagcgtcagctcgacggcccggactgtatccaacttctgatctttgaatctctctgttccaacatgttctgaaggagttctaagacttttcagaaagcttgtaacatgctttgtagactttctttgaattactcttgcaaactctgattgaacctacgtgaaaactgctccagaagttctaaccaaattccgtcttgggaaggcccaaaatttattgagtacttcagtttcatggacgtgtcttcaaagatttataacttgaaatcccatcatttttaagagaagttctgttccgcaatgtcttagatctcattgaaatctacaactcttgtgtcagaagttcttccagaatcaacttgcatcatggtgaaaatctggccagaagttctgaacttgtcatatttcttaacagttagaaaaatttctaagtgtttagaattttgacttttccaaagcaaacttgacttttgactttcttaataaaacaaacttcatattctaacatgtcttgatgaaatgtgattcttgaaatttgatgttgatgcaaaagtcaaagtttgacttttcagtgtgcaattgaccattttgctcttgtgccaattccaaacctaaattgatgtatcagtgctgcaaacttgatgtcatggaagatcttatgagaaaattcttgaagactgagaggaaaaattttgtagtacaacacaaagaatcctgtttttcatagtcggactagacacattaacataaaacaccacttcattcgaagagtgattgaagaaggaaatgtgcagttacctttctgcagttcataagagcaacttacagacacttttactaaaatactacaaagaggaagattttaacaacttagagaagtaatgggagttaaagagcaacacattaagggggagtgttaaaattaatgtgttgtaaccaccactacctttagtaagtattataagaaaattgtaatcatcacattataattattgtccttatttaaaattatgataaagttgtatcattaagattgagaaaaccaaatagtcctcgtcttgatttttgaattattgttttctatgttacttttcttcaagcctatataaaaactttgtaatgctaaattgtatgctggaaaaaaatgtgtaatgaattgaatagaaattatggtatttcaaagtccaaaatccatcaatagaaatttagtacaaaacgtaactcaaaaatattctcttattttaaattttacaacaatataaaaatattctcttattttaaattttacaataatataatttatcacctgtcacctttagaataccaccaacaatattaatacttagatattttattcttaataattttgagatctctcaatatatctgatatttattttatatttgtgtcatattttcttatgttttagagttaacccttatatcttggtcaaactagtaattcaatatatgagtttgtgaaggacacattgacatcttgaaacattggttttaaccttgttggaatgttaaaggtaataaaacattcagaattatgaccatctattaatatacttcctttgtcttttaaaaaagtgtgcatgaaaatgctctatggtaagctagagtgtcttgctggcctgtgtatatcaattccatttccagatggtagaaactgccactacgaataattagtcataagacacgtatgttaacacacgtccccttgcatgttttttgccatatattccgtctctttctttttcttcacgtataaaacaatgaactaattaatagagcgatcaagctgaacagttctttgctttcgaagttgccgcaacctaaacaggtttttccttcttctttcttcttattaactacgaccttgtcctttgcctatgtaaaattactaggttttcatcagttacactgattaagttcgttatagtggaagataaaatgccctcaaagcattttgcaggatatctttgatttttcaaagatatggaactgtagagtttgatagtgttcttgaatgtggttgcatgaagtttttttggtctgcatgttattttttcctcgaaatatgttttgagtccaacaagtgattcacttgggattcagaaagttgttttctcaatatgtaacagtttttttctatggagaaaaatcatagggaccgttggttttggcttctttaattttgagctcagattaaacccattttacccggtgttcttggcagaattgaaaacagtacgtagtaccgcgcctaccatgtgtgttgagaccgagaacaacgatggaatccctactgtggagatcgctttcgatggagagagagaaagagctgaggctaacgtgaagttgtctgctgagaagatggaacctgctgctttggctaagaccttcgctagaagatacgtggttatcgagggagttgagtacgatgtgaccgatttcaaacatcctggaggaaccgtgattttctacgctctctctaacactggagctgatgctactgaggctttcaaggagttccaccacagatctagaaaggctaggaaggctttggctgctttgccttctagacctgctaagaccgctaaagtggatgatgctgagatgctccaggatttcgctaagtggagaaaggagttggagagggacggattcttcaagccttctcctgctcatgttgcttacagattcgctgagttggctgctatgtacgctttgggaacctacttgatgtacgctagatacgttgtgtcctctgtgttggtttacgcttgcttcttcggagctagatgtggatgggttcaacacgagggaggacactcttctttgaccggaaacatctggtgggataagagaatccaagctttcactgctggattcggattggctggatctggagatatgtggaactccatgcacaacaagcaccacgctactcctcaaaaagtgaggcacgatatggatttggataccactcctgctgttgctttcttcaacaccgctgtggaggataatagacctaggggattctctaagtactggctcagattgcaagcttggaccttcattcctgtgacttctggattggtgttgctcttctggatgttcttcctccacccttctaaggctttgaagggaggaaagtacgaggagcttgtgtggatgttggctgctcacgtgattagaacctggaccattaaggctgttactggattcaccgctatgcaatcctacggactcttcttggctacttcttgggtttccggatgctacttgttcgctcacttctctacttctcacacccacttggatgttgttcctgctgatgagcacttgtcttgggttaggtacgctgtggatcacaccattgatatcgatccttctcagggatgggttaactggttgatgggatacttgaactgccaagtgattcaccacctcttcccttctatgcctcaattcagacaacctgaggtgtccagaagattcgttgctttcgctaagaagtggaacctcaactacaaggtgatgacttatgctggagcttggaaggctactttgggaaacctcgataatgtgggaaagcactactacgtgcacggacaacactctggaaagaccgcttgattaatgaaggccgcctcgaccgtaccccctgcagatagactatactatgttttagcctgcctgctggctagctactatgttatgttatgttgtaaaataaacacctgctaaggtatatctatctatattttagcatggctttctcaataaattgtctttccttatcgtttactatcttatacctaataatgaaataataatatcacatatgaggaacggggcaggtttaggcatatatatacgagtgtagggcggagtggggctacgtagcgtcacgtgacgttacctaagcctaggtagcctcagctgacgttacgtaacgctaggtaggctcagctgacacgggcaggacatagggactactacaagcatagtatgcttcagacaaagagctaggaaagaactcttgatggaggttaagagaaaaaagtgctagaggggcatagtaatcaaacttgtcaaaaccgtcatcatgatgagggatgacataatataaaaagttgactaaggtcttggtagtactctttgattagtattatatattggtgagaacatgagtcaagaggagacaagaaaccgaggaaccatagtttagcaacaagatggaagttgcaaagttgagctagccgctcgattagttacatctcctaagcagtactacaaggaatggtctctatactttcatgtttagcacatggtagtgcggattgacaagttagaaacagtgcttaggagacaaagagtcagtaaaggtattgaaagagtgaagttgatgctcgacaggtcaggagaagtccctccgccagatggtgactaccaaggggttggtatcagctgagacccaaataagattcttcggttgaaccagtggttcgaccgagactcttagggtgggatttcactgtaagatttgtgcattttgttgaatataaattgacaattttttttatttaattatagattatttagaatgaattacatatttagtttctaacaaggatagcaatggatgggtatgggtacaggttaaacatatctattacccacccatctagtcgtcgggttttacacgtacccacccgtttacataaaccagaccggaattttaaaccgtacccgtccgttagcgggtttcagatttacccgtttaatcgggtaaaacctgattactaaatatatattttttatttgataaacaaaacaaaaatgttaatattttcatattggatgcaattttaagaaacacatattcataaatttccatatttgtaggaaaataaaaagaaaaatatattcaagaacacaaatttcaccgacatgacttttattacagagttggaattagatctaacaattgaaaaattaaaattaagatagaatatgttgaggaacatgacatagtataatgctgggttacccgtcgggtaggtatcgaggcggatactactaaatccatcccactcgctatccgataatcactggtttcgggtatacccattcccgtcaacaggcctttttaaccggataatttcaacttatagtgaatgaattttgaataaatagttagaataccaaaatcctggattgcatttgcaatcaaattttgtgaaccgttaaattttgcatgtacttgggatagatataatagaaccgaattttcattagtttaatttataacttactttgttcaaagaaaaaaaatatctatccaatttacttataataaaaaataatctatccaagttacttattataatcaacttgtaaaaaggtaagaatacaaatgtggtagcgtacgtgtgattatatgtgacgaaatgttatatctaacaaaagtccaaattcccatggtaaaaaaaatcaaaatgcatggcaggctgtttgtaaccttggaataagatgttggccaattctggagccgccacgtacgcaagactcagggccacgttctcttcatgcaaggatagtagaacaccactccacccacctcctatattagacctttgcccaaccctccccaactttcccatcccatccacaaagaaaccgacatttttatcataaatctggtgcttaaacactctggtgagttctagtacttctgctatgatcgatctcattaccatttcttaaatttctctccctaaatattccgagttcttgatttttgataacttcaggttttctctttttgataaatctggtctttccattttttttttttgtggttaatttagtttcctatgttcttcgattgtattatgcatgatctgtgtttggattctgttagattatgtattggtgaatatgtatgtgtttttgcatgtctggttttggtcttaaaaatgttcaaatctgatgatttgattgaagcttttttagtgttggtttgattcttctcaaaactactgttaatttactatcatgttttccaactttgattcatgatgacacttttgttctgctttgttataaaattttggttggtttgattttgtaattatagtgtaattttgttaggaatgaacatgttttaatactctgttttcgatttgtcacacattcgaattattaatcgataatttaactgaaaattcatggttctagatcttgttgtcatcagattatttgtttcgataattcatcaaatatgtagtccttttgctgatttgcgactgtttcattttttctcaaaattgttttttgttaagtttatctaacagttatcgttgtcaaaagtctctttcattttgcaaaatcttctttttttttttgtttgtaactttgttttttaagctacacatttagtctgtaaaatagcatcgaggaacagttgtcttagtagacttgcatgttcttgtaacttctatttgtttcagtttgttgatgactgctttgattttgtaggtcaaaggcgcaccctaccatggatgcttataacgctgctatggataagattggagctgctatcatcgattggagtgatccagatggaaagttcagagctgatagggaggattggtggttgtgcgatttcagatccgctatcaccattgctctcatctacatcgctttcgtgatcttgggatctgctgtgatgcaatctctcccagctatggacccataccctatcaagttcctctacaacgtgtctcaaatcttcctctgcgcttacatgactgttgaggctggattcctcgcttataggaacggatacaccgttatgccatgcaaccacttcaacgtgaacgatccaccagttgctaacttgctctggctcttctacatctccaaagtgtgggatttctgggataccatcttcattgtgctcggaaagaagtggagacaactctctttcttgcacgtgtaccaccacaccaccatcttcctcttctactggttgaacgctaacgtgctctacgatggagatatcttcttgaccatcctcctcaacggattcattcacaccgtgatgtacacctactacttcatctgcatgcacaccaaggattctaagaccggaaagtctttgccaatctggtggaagtcatctttgaccgctttccaactcttgcaattcaccatcatgatgtcccaagctacctacttggttttccacggatgcgataaggtttccctcagaatcaccatcgtgtacttcgtgtacattctctcccttttcttcctcttcgctcagttcttcgtgcaatcctacatggctccaaagaagaagaagtccgcttgatgttaatgaaggccgcagatatcagatctggtcgacctagaggatccccggccgcaaagataataacaaaagcctactatataacgtacatgcaagtattgtatgatattaatgtttttacgtacgtgtaaacaaaaataattacgtttgtaacgtatggtgatgatgtggtgcactaggtgtaggccttgtattaataaaaagaagtttgttctatatagagtggtttagtacgacgatttatttactagtcggattggaatagagaaccgaattcttcaatccttgcttttgatcaagaattgaaaccgaatcaaatgtaaaagttgatatatttgaaaaacgtattgagcttatgaaaatgctaatactctcatctgtatggaaaagtgactttaaaaccgaacttaaaagtgacaaaaggggaatatcgcatcaaaccgaatgaaaccgatctacgtaggctcagctgagcttagctaagcctacctagcctcacgtgagattatgtaaggctaggtagcgtcacgtgacgttacctaacactagctagcgtcagctgagcttagctaaccctacgtagcctcacgtgagcttacctaacgctacgtagcctcacgtgactaaggatgacctacccattcttgagacaaatgttacattttagtatcagagtaaaatgtgtacctataactcaaattcgattgacatgtatccattcaacataaaattaaaccagcctgcacctgcatccacatttcaagtattttcaaaccgttcggctcctatccaccgggtgtaacaagacggattccgaatttggaagattttgactcaaattcccaatttatattgaccgtgactaaatcaactttaacttctataattctgattaagctcccaatttatattcccaacggcactacctccaaaatttatagactctcatccccttttaaaccaacttagtaaacgttttttttttaattttatgaagttaagtttttaccttgtttttaaaaagaatcgttcataagatgccatgccagaacattagctacacgttacacatagcatgcagccgcggagaattgtttttcttcgccacttgtcactcccttcaaacacctaagagcttctctctcacagcacacacatacaatcacatgcgtgcatgcattattacacgtgatcgccatgcaaatctcctttatagcctataaattaactcatcggcttcactctttactcaaaccaaaactcatcaatacaaacaagattaaaaacatttcacgatttggaatttgattcctgcgatcacaggtatgacaggttagattttgttttgtatagttgtatacatacttctttgtgatgttttgtttacttaatcgaatttttggagtgttttaaggtctctcgtttagaaatcgtggaaaatatcactgtgtgtgtgttcttatgattcacagtgtttatgggtttcatgttctttgttttatcattgaatgggaagaaatttcgttgggatacaaatttctcatgttcttactgatcgttattaggagtttggggaaaaaggaagagtttttttggttggttcgagtgattatgaggttatttctgtatttgatttatgagttaatggtcgttttaatgttgtagaccgccatggctattttgaaccctgaggctgattctgctgctaacctcgctactgattctgaggctaagcaaagacaattggctgaggctggatacactcacgttgagggtgctcctgctcctttgcctttggagttgcctcacttctctctcagagatctcagagctgctattcctaagcactgcttcgagagatctttcgtgacctccacctactacatgatcaagaacgtgttgacttgcgctgctttgttctacgctgctaccttcattgatagagctggagctgctgcttatgttttgtggcctgtgtactggttcttccagggatcttacttgactggagtgtgggttatcgctcacgagtgtggacaccaggcttattgctcttctgaggtggtgaacaacttgattggactcgtgttgcactctgctttgttggtgccttaccactcttggagaatctctcacagaaagcaccactccaacactggatcttgcgagaacgatgaggttttcgttcctgtgaccagatctgtgttggcttcttcttggaacgagaccttggaggattctcctctctaccaactctaccgtatcgtgtacatgttggttgttggatggatgcctggatacctcttcttcaacgctactggacctactaagtactggggaaagtctaggtctcacttcaacccttactccgctatctatgctgatagggagaggtggatgatcgtgctctccgatattttcttggtggctatgttggctgttttggctgctttggtgcacactttctccttcaacacgatggtgaagttctacgtggtgccttacttcattgtgaacgcttacttggtgttgattacctacctccaacacaccgatacctacatccctcacttcagagagggagagtggaattggttgagaggagctttgtgcactgtggatagatcatttggtccattcctcgattctgtggtgcatagaatcgtggatacccacgtttgccaccatatcttctccaagatgcctttctatcactgcgaggaggctaccaacgctattaagcctctcctcggaaagttctacttgaaggatactactcctgttcctgttgctctctggagatcttacacccactgcaagttcgttgaggatgatggaaaggtggtgttctacaagaacaagttatagttaatgaataattgattggttcgagtattatggcattgggaaaactgtttttcttgtaccatttgttgtgcttgtaatttactgtgttttttattcggttttcgctatcgaactgtgaaatggaaatggatggagaagagttaatgaatgatatggtccttttgttcattctcaaattaatattatttgttttttctcttatttgttgtgtgttgaatttgaaattataagagatatgcaaacattttgttttgagtaaaaatgtgtcaaatcgtggcctctaatgaccgaagttaatatgaggagtaaaacacttgtagttgtaccattatgcttattcactaggcaacaaatatattttcagacctagaaaagctgcaaatgttactgaatacaagtatgtcctcttgtgttttagacatttatgaactttcctttatgtaattttccagaatccttgtcagattctaatcattgctttataattatagttatactcatggatttgtagttgagtatgaaaatattttttaatgcattttatgacttgccaattgattgacaacatgcatcaatctagctagcctcagctgacgttacgtaacgctaggtagcgtcacgtgacgttagctaacgctaggtagcgtcagctgagcttacgtaagcgcacagatgaatactagctgttgttcacagttctagtgtctcctcattacgtgaattcaagctacgatcactatctcaactcctacataaacatcagaatgctacaaaactatgcacaaaaacaaaagctacatctaatacgtgaatcaattactctcatcacaagaaagaagatttcaatcaccgtcgagaaggaggattcagttaattgaatcaaagttccgatcaaactcgaagactggtgagcacgaggacgacgaagaagagtgtctcgaagatacaacaagcaagaaatctactgagtgacctcctgaagttattggcgcgattgagagaatcaatccgaattaatttcggggaaaaagataaattagatactaagcgatgggcttgggctgggctaagaaacaggtggcaattgggctggaggaccccgcgattcatagcttccgatagcccaaaaaaaaacggataacatatttatcgggtatttgaatttcagtgaaataagatattttctttttgttaggaaaattttagaaaataatggaaattaaatagcgattatgttacaagatacgatcagcatcgggcagtgcaaaatgctatagcttcccaagatttgatccttttgggttatctcctaatgacaattagtttaggattttgaaacttatattaatactattatccgacaacacttgtttcagcttcttattttaacattttttgtttttttctattcttcttcccatcagcattttctttttaaaaaattgaatactttaactttttaaaaatttcacaatgatcagatgatattatggaagatctcaagagttaaatgtatccatcttggggcattaaaaccggtgtacgggatgataaatacagactttatatcatatgatagctcagtaattcatatttatcacgttgctaaaaaaattataaggtactagtagtcaacaaaatcaattaaagagaaagaaagaaacgcatgtgaagagagtttacaactggaaaagtaaaataaaaattaacgcatgttgaatgctgacatgtcagtatgtccatgaatccacgtatcaagcgccattcatcgatcgtcttcctctttctaaatgaaaacaacttcacacatcacaacaaacaatacacacaagaccccctctctctcgttgtctctctgccagcgaccaaatcgaagcttgagaagaacaagaaggggtcaaaccatggcttctacatctgctgctcaagacgctgctccttacgagttcccttctctcactgagatcaagagggctcttccttctgagtgtttcgaggcttctgttcctctttctctctactacaccgctagatctcttgctcttgctggatctctcgctgttgctctctcttacgctagagctttgcctcttgttcaggctaacgctcttcttgatgctactctctgcactggatacgttcttctccagggaatcgttttctggggattcttcaccgttggtcacgattgtggacacggagctttctctagatctcacgtgctcaacttctctgttggaaccctcatgcactctatcatccttacccctttcgagtcttggaagctctctcacagacaccaccacaagaacaccggaaacatcgataaggacgagatcttctaccctcaaagagaggctgattctcaccctgtttctagacaccttgtgatgtctcttggatctgcttggttcgcttaccttttcgctggattccctcctagaaccatgaaccacttcaacccttgggaggctatgtatgttagaagagtggctgctgtgatcatctctctcggagttcttttcgctttcgctggactctactcttacctcaccttcgttcttggattcaccactatggctatctactacttcggacctctcttcatcttcgctaccatgcttgttgttaccactttcctccaccacaacgatgaggagacaccttggtacgctgattctgagtggacttacgtgaagggaaacctctcttctgtggacagatcttacggtgctctcatcgacaaccttagccacaacatcggaactcaccagatccaccacctcttccctatcatccctcactacaagctcaacgatgctactgctgctttcgctaaggctttccctgagcttgttaggaaaaacgctgctcctatcatcccaactttcttcaggatggctgctatgtacgctaagtacggagttgttgacactgatgctaagaccttcactctcaaggaggctaaggctgctgctaagactaagtcatcttgatgattaatgaataattgattgtacatactatattttttgtttaccttgtgttagtttaatgttcagtgtcctctctttattgtggcacgtctctttgttgtatgttgtgtctatacaaagttgaaataatggaaagaaaaggaagagtgtaatttgttttgttttaagtgtttataaatatatatatataggtcatttagatagttctaggtttctataaaactctctctctggaagtagaatctgtttttgagaggatccagttgcctactaatctcccccaaaacccttcaagcttaaccttcctcttcacaacaacagaggaaacacatctcttgagctctgagttctcttctttgagcatgtctatcgctaaactcatctgccttatagcttccctcttctcttcatctctctctctcaccatttcgctgtaaaacttattctcctccctcagcctctctatctcttccttcagcatctcacaattcccaccataatcgactgaggatgattcaccgtcatcaacttcagactcagcgttgtagtcgtcatgagtctcacaagccttggaccaagaagactcatcatcgcaagttgatgatttatcatgatgcttctctgagccgtgtttgctacgtagcgtcacgtgacgttacctaagcctaggtagcctcagctgacgttacgtaacgctaggtaggctcagctgactgcagcaaatttacacattgccactaaacgtctaaacccttgtaatttgtttttgttttactatgtgtgttatgtatttgatttgcgataaatttttatatttggtactaaatttataacaccttttatgctaacgtttgccaacacttagcaatttgcaagttgattaattgattctaaattatttttgtcttctaaatacatatactaatcaactggaaatgtaaatatttgctaatatttctactataggagaattaaagtgagtgaatatggtaccacaaggtttggagatttaattgttgcaatgctgcatggatggcatatacaccaaacattcaataattcttgaggataataatggtaccacacaagatttgaggtgcatgaacgtcacgtggacaaaaggtttagtaatttttcaagacaacaatgttaccacacacaagttttgaggtgcatgcatggatgccctgtggaaagtttaaaaatattttggaaatgatttgcatggaagccatgtgtaaaaccatgacatccacttggaggatgcaataatgaagaaaactacaaatttacatgcaactagttatgcatgtagtctatataatgaggattttgcaatactttcattcatacacactcactaagttttacacgattataatttcttcatagccagtactgtttaagcttcactgtctctgaatcggcaaaggtaaacgtatcaattattctacaaacccttttatttttcttttgaattaccgtcttcattggttatatgataacttgataagtaaagcttcaataattgaatttgatctgtgtttttttggccttaatactaaatccttacataagctttgttgcttctcctcttgtgagttgagtgttaagttgtaataatggttcactttcagctttagaagaaacgcgccttccatggctacaaaggaggcttacgttttcccaactctcaccgagatcaagagatctctcccaaaggattgcttcgaggcttctgtgcctttgtctctctactacactgtgagatgcttggttattgctgtggctttgaccttcggattgaactacgctagagctttgccagaggttgagtctttctgggctttggatgctgctttgtgcactggatatatcctcctccagggaattgtgttctggggattcttcactgttggacacgatgctggacacggagctttctctagataccacctcttgaacttcgttgtgggaaccttcatgcactctctcatcttgaccccattcgagtcttggaagttgacccacagacaccaccacaagaacaccggaaacatcgatagagatgaggtgttctacccacagagaaaggctgatgatcacccattgtccaggaacttgatcttggctttgggagctgcttggcttgcttatttggtggagggattcccaccaagaaaggtgaaccacttcaacccattcgagccactttttgtgagacaagtgtccgctgtggttatctctttgctcgctcacttcttcgttgctggactctctatctacttgtctctccagttgggacttaagaccatggctatctactactacggaccagttttcgtgttcggatctatgttggtgattaccaccttcttgcaccacaacgatgaggagactccatggtatgctgattctgagtggacttacgtgaagggaaacttgtcctctgtggatagatcttacggtgctctcatcgataacctctcccacaacatcggaactcaccagatccaccacctcttcccaattatcccacactacaagctcaagaaggctactgctgctttccaccaagctttcccagagcttgtgagaaagtccgatgagccaatcatcaaggctttcttcagagtgggaaggttgtatgctaactacggagtggttgatcaagaggctaagctcttcactttgaaggaggctaaggctgctactgaagctgctgctaagaccaagtctacctgattaatgaatcgacaagctcgagtttctccataataatgtgtgagtagttcccagataagggaattagggttcctatagggtttcgctcatgtgttgagcatataagaaacccttagtatgtatttgtatttgtaaaatacttctatcaataaaatttctaattcctaaaaccaaaatccagtactaaaatccagatcccccgaattaattcggcgttaattcagctacgtaggctcagctgagcttacctaaggctacgtaggctcacgtgacgttacgtaaggctacgtagcgtcacgtgagcttacctaactctagctagcctcacgtgaccttagctaacactaggtagcgtcagcacagatgaatactagctgttgttcacagttctagtgtctcctcattacgtgaattcaagctacgatcactatctcaactcctacataaacatcagaatgctacaaaactatgcacaaaaacaaaagctacatctaatacgtgaatcaattactctcatcacaagaaagaagatttcaatcaccgtcgagaaggaggattcagttaattgaatcaaagttccgatcaaactcgaagactggtgagcacgaggacgacgaagaagagtgtctcgaagatacaacaagcaagaaatctactgagtgacctcctgaagttattggcgcgattgagagaatcaatccgaattaatttcggggaaaaagataaattagatactaagcgatgggcttgggctgggctaagaaacaggtggcaattgggctggaggaccccgcgattcatagcttccgatagcccaaaaaaaaacggataacatatttatcgggtatttgaatttcagtgaaataagatattttctttttgttaggaaaattttagaaaataatggaaattaaatagcgattatgttacaagatacgatcagcatcgggcagtgcaaaatgctatagcttcccaagatttgatccttttgggttatctcctaatgacaattagtttaggattttgaaacttatattaatactattatccgacaacacttgtttcagcttcttattttaacattttttgtttttttctattcttcttcccatcagcattttctttttaaaaaattgaatactttaactttttaaaaatttcacaatgatcagatgatattatggaagatctcaagagttaaatgtatccatcttggggcattaaaaccggtgtacgggatgataaatacagactttatatcatatgatagctcagtaattcatatttatcacgttgctaaaaaaattataaggtactagtagtcaacaaaatcaattaaagagaaagaaagaaacgcatgtgaagagagtttacaactggaaaagtaaaataaaaattaacgcatgttgaatgctgacatgtcagtatgtccatgaatccacgtatcaagcgccattcatcgatcgtcttcctctttctaaatgaaaacaacttcacacatcacaacaaacaatacacacaagaccccctctctctcgttgtctctctgccagcgaccaaatcgaagcttgagaagaacaagaaggggtcaaaccatgggaaaaggatctgagggaagatctgctgctagagagatgactgctgaggctaacggagataagagaaagaccatcctcattgagggagtgttgtacgatgctaccaacttcaaacacccaggaggttccattattaacttcctcaccgagggagaagctggagttgatgctacccaagcttacagagagttccatcagagatccggaaaggctgataagtacctcaagtccctcccaaagttggatgcttctaaggtggagtctaggttctctgctaaggagcaggctagaagggacgctatgaccagggattacgctgctttcagagaggagttggttgctgagggatacttcgatccatctatcccacacatgatctacagagtggtggagattgtggctttgttcgctttgtctttctggttgatgtctaaggcttctccaacctctttggttttgggagtggtgatgaacggaatcgctcaaggaagatgcggatgggttatgcacgagatgggacacggatctttcactggagttatctggctcgatgataggatgtgcgagttcttctacggagttggatgtggaatgtctggacactactggaagaaccagcactctaagcaccacgctgctccaaacagattggagcacgatgtggatttgaacaccttgccactcgttgctttcaacgagagagttgtgaggaaggttaagccaggatctttgttggctttgtggctcagagttcaggcttatttgttcgctccagtgtcttgcttgttgatcggattgggatggaccttgtacttgcacccaagatatatgctcaggaccaagagacacatggagtttgtgtggatcttcgctagatatatcggatggttctccttgatgggagctttgggatattctcctggaacttctgtgggaatgtacctctgctctttcggacttggatgcatctacatcttcctccaattcgctgtgtctcacacccacttgccagttaccaacccagaggatcaattgcactggcttgagtacgctgctgatcacaccgtgaacatctctaccaagtcttggttggttacctggtggatgtctaacctcaacttccaaatcgagcaccacttgttcccaaccgctccacaattcaggttcaaggagatctctccaagagttgaggctctcttcaagagacacaacctcccttactacgatttgccatacacctctgctgtttctactaccttcgctaacctctactctgttggacactctgttggagctgataccaagaagcaggattgatgattaatgaataattgattgtacatactatattttttgtttaccttgtgttagtttaatgttcagtgtcctctctttattgtggcacgtctctttgttgtatgttgtgtctatacaaagttgaaataatggaaagaaaaggaagagtgtaatttgttttgttttaagtgtttataaatatatatatataggtcatttagatagttctaggtttctataaaactctctctctggaagtagaatctgtttttgagaggatccagttgcctactaatctcccccaaaacccttcaagcttaaccttcctcttcacaacaacagaggaaacacatctcttgagctctgagttctcttctttgagcatgtctatcgctaaactcatctgccttatagcttccctcttctcttcatctctctctctcaccatttcgctgtaaaacttattctcctccctcagcctctctatctcttccttcagcatctcacaattcccaccataatcgactgaggatgattcaccgtcatcaacttcagactcagcgttgtagtcgtcatgagtctcacaagccttggaccaagaagactcatcatcgcaagttgatgatttatcatgatgcttctctgagccgtgtttgctacctagagtcagctgagcttagctaacgctagctagtgtcagctgacgttacgtaaggctaactagcgtcacgtgaccttacgtaacgctacgtaggctcagctgagcttagctaaccctagctagtgtcacgtgagcttacgctactatagaaaatgtgttatatcgacatgaccagacaaaggggcaacagttaacaaaacaattaattctttcatttgagattaaggaaggtaaggtactaaaaagattaaaaaaaatgagcttatctctttgtttctgtaataataatataagtgtgataaacttttaatataataattgtaattaggttttctacagatgagcaccactcagagacaagataagaagaaaacaattttgttaaacatgattatagaaacttttagttaagtcttgaagtatcaatataacaaaaaaaagtacacacgactatgacaataaacccactaccgtcaggttatcatttcgatgaaatgttttgatatcattaaatataacagtcacaaaaaatcatctaattataacaatataacttatacatatatttaactaaaaacttagagtttttgtaatgattctaattgatgattagagtttatagaaatacaattaaataaaaaatataattttaaaaaaacatagtaaagtcaatgagatcctctctgacctcagtgatcatttagtcatgtatgtacaacaatcattgttcatcacatgactgtaaaataaataaggataaacttgggaatatatataatatattgtattaaataaaaaagggaaatacaaatatcaattttagattcccgagttgacacaactcaccatgcacgctgccacctcagctcccagctctcgtcacatgtctcatgtcagttaggtctttggtttttagtctttgacacaactcgccatgcatgttgccacgtgagctcgttcctcttcccatgatctcaccactgggcatgcatgctgccacctcagctggcacctcttctctatatgtccctagaggccatgcacagtgccacctcagcactcctctcagaacccatacgtacctgccaatcggcttctctccataaatatctatttaaattataactaattatttcatatacttaattgatgacgtggatgcattgccatcgttgtttaataattgttaattacgacatgataaataaaatgaaagtaaaaagtacgaaagattttccatttgttgttgtataaatagagaagtgagtgatgcataatgcatgaatgcatgaccgcgccaccatgactgttggatacgacgaggagatcccattcgagcaagttagggctcataacaagccagacgacgcttggtgtgctattcacggacacgtgtacgacgttaccaagttcgcttcagttcacccaggaggagatattatcttgctcgctgctggaaaggaagctactgtcctctacgagacctaccatgttagaggagtgtctgacgctgtgctcagaaagtacagaataggaaagttgccagacggacaaggaggagctaacgagaaggagaagagaaccttgtctggattgtcctctgcttcttactacacctggaactccgatttctacagagtgatgagggagagagttgtggctagattgaaggagagaggaaaggctagaagaggaggatacgaactctggatcaaggctttcttgctccttgttggattctggtcctctctttactggatgtgcaccctcgatccatctttcggagctatcttggctgctatgtctttgggagtgttcgctgcttttgttggaacctgcatccaacacgatggaaaccacggagctttcgctcaatctagatgggttaacaaggtggcaggatggactttggatatgatcggagcttctggaatgacttgggagttccaacacgtgttgggacaccacccatacactaacttgatcgaggaggagaacggattgcaaaaggtgtccggaaagaagatggataccaagttggctgatcaagagtctgatccagatgtgttctccacctacccaatgatgagattgcacccttggcaccagaagaggtggtatcacaggttccagcacatctacggacctttcatcttcggattcatgaccatcaacaaggtggtgactcaagatgttggagtggtgttgagaaagagactcttccaaatcgatgctgagtgcagatatgcttccccaatgtacgttgctaggttctggattatgaaggctttgaccgtgttgtatatggttgctttgccttgttatatgcaaggaccttggcacggattgaaactcttcgctatcgctcacttcacttgcggagaggttttggctaccatgttcatcgtgaaccacattatcgagggagtgtcttacgcttctaaggatgctgttaagggaactatggctccaccaaagactatgcacggagtgaccccaatgaacaacactagaaaggaggttgaggctgaggcttctaagtctggagctgtggttaagtctgtgccattggatgattgggctgctgttcagtgccaaacctctgtgaactggtctgttggatcttggttttggaaccacttctctggaggactcaaccaccaaatcgagcaccacctcttcccaggattgtctcacgagacctactaccacatccaagacgtggttcaatctacctgtgctgagtacggagttccataccaacacgagccatctttgtggactgcttactggaagatgctcgaacaccttagacaattgggaaacgaggagactcacgagtcatggcagagagctgcttgattaatgaactaagactcccaaaaccaccttccctgtgacagttaaaccctgcttatacctttcctcctaataatgttcatctgtcacacaaactaaaataaataaaatgggagcaataaataaaatgggagctcatatatttacaccatttacactgtctattattcaccatgccaattattacttcataattttaaaattatgtcatttttaaaaattgcttaatgatggaaaggattattataagttaaaagtataacatagataaactaaccacaaaacaaatcaatataaactaacttactctcccatctaatttttatttaaatttctttacacttctcttccatttctatttctacaacattatttaacatttttattgtatttttcttactttctaactctattcatttcaaaaatcaatatatgtttatcaccacctctctaaaaaaaactttacaatcattggtccagaaaagttaaatcacgagatggtcattttagcattaaaacaacgattcttgtatcactatttttcagcatgtagtccattctcttcaaacaaagacagcggctatataatcgttgtgttatattcagtctaaaacaactagctagcctcagctgacgttacgtaacgctaggtagcgtcacgtgacgttagctaacgctaggtagcgtcagctgagcttacgtaagcgccacgggcaggacatagggactactacaagcatagtatgcttcagacaaagagctaggaaagaactcttgatggaggttaagagaaaaaagtgctagaggggcatagtaatcaaacttgtcaaaaccgtcatcatgatgagggatgacataatataaaaagttgactaaggtcttggtagtactctttgattagtattatatattggtgagaacatgagtcaagaggagacaagaaaccgaggaaccatagtttagcaacaagatggaagttgcaaagttgagctagccgctcgattagttacatctcctaagcagtactacaaggaatggtctctatactttcatgtttagcacatggtagtgcggattgacaagttagaaacagtgcttaggagacaaagagtcagtaaaggtattgaaagagtgaagttgatgctcgacaggtcaggagaagtccctccgccagatggtgactaccaaggggttggtatcagctgagacccaaataagattcttcggttgaaccagtggttcgaccgagactcttagggtgggatttcactgtaagatttgtgcattttgttgaatataaattgacaattttttttatttaattatagattatttagaatgaattacatatttagtttctaacaaggatagcaatggatgggtatgggtacaggttaaacatatctattacccacccatctagtcgtcgggttttacacgtacccacccgtttacataaaccagaccggaattttaaaccgtacccgtccgttagcgggtttcagatttacccgtttaatcgggtaaaacctgattactaaatatatattttttatttgataaacaaaacaaaaatgttaatattttcatattggatgcaattttaagaaacacatattcataaatttccatatttgtaggaaaataaaaagaaaaatatattcaagaacacaaatttcaccgacatgacttttattacagagttggaattagatctaacaattgaaaaattaaaattaagatagaatatgttgaggaacatgacatagtataatgctgggttacccgtcgggtaggtatcgaggcggatactactaaatccatcccactcgctatccgataatcactggtttcgggtatacccattcccgtcaacaggcctttttaaccggataatttcaacttatagtgaatgaattttgaataaatagttagaataccaaaatcctggattgcatttgcaatcaaattttgtgaaccgttaaattttgcatgtacttgggatagatataatagaaccgaattttcattagtttaatttataacttactttgttcaaagaaaaaaaatatctatccaatttacttataataaaaaataatctatccaagttacttattataatcaacttgtaaaaaggtaagaatacaaatgtggtagcgtacgtgtgattatatgtgacgaaatgttatatctaacaaaagtccaaattcccatggtaaaaaaaatcaaaatgcatggcaggctgtttgtaaccttggaataagatgttggccaattctggagccgccacgtacgcaagactcagggccacgttctcttcatgcaaggatagtagaacaccactccacccacctcctatattagacctttgcccaaccctccccaactttcccatcccatccacaaagaaaccgacatttttatcataaatcagggtttcgtttttgtttcatcgataaactcaaaggtgatgattttagggtcttgtgagtgtgcttttttgtttgattctactgtagggtttatgttctttagctcataggttttgtgtatttcttagaaatgtggcttctttaatctctgggtttgtgactttttgtgtggtttctgtgtttttcatatcaaaaacctattttttccgagtttttttttacaaattcttactctcaagcttgaatacttcacatgcagtgttcttttgtagattttagagttaatgtgttaaaaagtttggatttttcttgcttatagagcttcttcactttgattttgtgggtttttttgttttaaaggtgagatttttgatgaggtttttgcttcaaagatgtcacctttctgggtttgtcttttgaataaagctatgaactgtcacatggctgacgcaattttgttactatgtcatgaaagctgacgtttttccgtgttatacatgtttgcttacacttgcatgcgtcaaaaaaattggggctttttagttttagtcaaagattttacttctcttttgggatttatgaaggaaagttgcaaactttctcaaattttaccatttttgctttgatgtttgtttagattgcgacagaacaaactcatatatgttgaaatttttgcttggttttgtataggattgtgtcttttgcttataaatgttgaaatctgaactttttttttgtttggtttctttgagcaggagataaggcgcaccaccatggcttctacatctgctgctcaagacgctgctccttacgagttcccttctctcactgagatcaagagggctcttccttctgagtgtttcgaggcttctgttcctctttctctctactacaccgctagatctcttgctcttgctggatctctcgctgttgctctctcttacgctagagctttgcctcttgttcaggctaacgctcttcttgatgctactctctgcactggatacgttcttctccagggaatcgttttctggggattcttcaccgttggtcacgattgtggacacggagctttctctagatctcacgtgctcaacttctctgttggaaccctcatgcactctatcatccttacccctttcgagtcttggaagctctctcacagacaccaccacaagaacaccggaaacatcgataaggacgagatcttctaccctcaaagagaggctgattctcaccctgtttctagacaccttgtgatgtctcttggatctgcttggttcgcttaccttttcgctggattccctcctagaaccatgaaccacttcaacccttgggaggctatgtatgttagaagagtggctgctgtgatcatctctctcggagttcttttcgctttcgctggactctactcttacctcaccttcgttcttggattcaccactatggctatctactacttcggacctctcttcatcttcgctaccatgcttgttgttaccactttcctccaccacaacgatgaggagacaccttggtacgctgattctgagtggacttacgtgaagggaaacctctcttctgtggacagatcttacggtgctctcatcgacaaccttagccacaacatcggaactcaccagatccaccacctcttccctatcatccctcactacaagctcaacgatgctactgctgctttcgctaaggctttccctgagcttgttaggaaaaacgctgctcctatcatcccaactttcttcaggatggctgctatgtacgctaagtacggagttgttgacactgatgctaagaccttcactctcaaggaggctaaggctgctgctaagactaagtcatcttgatgattaatgaaggccgcagatatcagatctggtcgacctagaggatccccggccgcaaagataataacaaaagcctactatataacgtacatgcaagtattgtatgatattaatgtttttacgtacgtgtaaacaaaaataattacgtttgtaacgtatggtgatgatgtggtgcactaggtgtaggccttgtattaataaaaagaagtttgttctatatagagtggtttagtacgacgatttatttactagtcggattggaatagagaaccgaattcttcaatccttgcttttgatcaagaattgaaaccgaatcaaatgtaaaagttgatatatttgaaaaacgtattgagcttatgaaaatgctaatactctcatctgtatggaaaagtgactttaaaaccgaacttaaaagtgacaaaaggggaatatcgcatcaaaccgaatgaaaccgatctacgtaggctcagctgagcttacctaaggctacgtaggctcacgtgacgttacgtaaggctacgtagcgtcacgtgagcttacctaactctagctagcctcacgtgaccttagctaacactaggtagcgtcagcttagcagatatttggtgtctaaatgtttattttgtgatatgttcatgtttgaaatggtggtttcgaaaccagggacaacgttgggatctgatagggtgtcaaagagtattatggattgggacaatttcggtcatgagttgcaaattcaagtatatcgttcgattatgaaaattttcgaagaatatcccatttgagagagtctttacctcattaatgtttttagattatgaaattttatcatagttcatcgtagtctttttggtgtaaaggctgtaaaaagaaattgttcacttttgttttcgtttatgtgaaggctgtaaaagattgtaaaagactattttggtgttttggataaaatgatagtttttatagattcttttgcttttagaagaaatacatttgaaattttttccatgttgagtataaaataccgaaatcgattgaagatcatagaaatattttaactgaaaacaaatttataactgattcaattctctccatttttatacctatttaaccgtaatcgattctaatagatgatcgattttttatataatcctaattaaccaacggcatgtattggataattaaccgatcaactctcacccctaatagaatcagtattttccttcgacgttaattgatcctacactatgtaggtcatatccatcgttttaatttttggccaccattcaattctgtcttgcctttagggatgtgaatatgaacggccaaggtaagagaataaaaataatccaaattaaagcaagagaggccaagtaagataatccaaatgtacacttgtcattgccaaaattagtaaaatactcggcatattgtattcccacacattattaaaataccgtatatgtattggctgcatttgcatgaataatactacgtgtaagcccaaaagaacccacgtgtagcccatgcaaagttaacactcacgaccccattcctcagtctccactatataaacccaccatccccaatctcaccaaacccaccacacaactcacaactcactctcacaccttaaagaaccaatcaccaccaaaaaaagttctttgctttcgaagttgccgcaacctaaacaggtttttccttcttctttcttcttattaactacgaccttgtcctttgcctatgtaaaattactaggttttcatcagttacactgattaagttcgttatagtggaagataaaatgccctcaaagcattttgcaggatatctttgatttttcaaagatatggaactgtagagtttgatagtgttcttgaatgtggttgcatgaagtttttttggtctgcatgttattttttcctcgaaatatgttttgagtccaacaagtgattcacttgggattcagaaagttgttttctcaatatgtaacagtttttttctatggagaaaaatcatagggaccgttggttttggcttctttaattttgagctcagattaaacccattttacccggtgttcttggcagaattgaaaacagtacgtagtaccgcgcctaccatgccacctagtgctgctagtgaaggtggtgttgctgaacttagagctgctgaagttgctagctacactagaaaggctgttgacgaaagacctgacctcactatagttggtgacgctgtttacgacgctaaggcttttagggacgagcaccctggtggtgctcacttcgttagccttttcggaggtagggacgctactgaggcttttatggaatatcaccgtagagcttggcctaaggctaggatgtctaagttcttcgttggttcacttgacgctagcgagaagcctactcaagctgattcatcttaccttagactttgcgctgaggttaacgctcttttgcctaagggtagcggaggattcgctcctcctagctactggcttaaggctgctgctcttgttgttgctgctgttagtatagagggttatatgctccttaggggtaagacccttttgcttagcgttttccttggactcgtgttcgcttggataggacttaatattcagcacgacgctaatcacggtgctcttagtagacactcagtgattaactactgcctcggttacgctcaggattggataggtggtaatatggtgctttggcttcaagagcacgttgtgatgcaccacctccacactaacgacgttgacgctgatcctgatcaaaaggctcacggtgttcttagacttaagcctactgacggttggatgccttggcacgcacttcaacaactctatatccttcctggtgaggctatgtacgcttttaagcttcttttcttggacgcccttgagcttcttgcttggaggtgggagggtgagaagattagccctcttgctagagctttgttcgctcctgctgttgcttgtaagcttggattctgggctagattcgttgctctccctctctggcttcaacctactgttcacactgctttgtgtatctgtgctactgtgtgtactggtagcttctacctcgccttcttcttctttatctctcacaacttcgacggtgttggtagcgttggacctaagggatcacttcctagatcagctactttcgttcaacgtcaggttgagactagctctaacgttggtggttactggcttggagttcttaacggtggacttaactttcagatagagcaccacttgttccctaggcttcaccactcttactacgctcaaatagctcctgtggttaggactcacatagagaagctcggttttaagtaccgtcacttccctaccgttggatctaaccttagctcaatgcttcagcatatgggtaagatgggaactagacctggtgctgagaagggtggtaaggctgagtagtgattaatgaataattgattgctgctttaatgagatatgcgagacgcctatgatcgcatgatatttgctttcaattctgttgtgcacgttgtaaaaaacctgagcatgtgtagctcagatccttaccgccggtttcggttcattctaatgaatatatcacccgttactatcgtatttttatgaataatattctccgttcaatttactgattgtctacgtagcgtcacctgacgttacgtaaggctacctaggctcacgtgacgttacgtaacgctacgtagcgtcaggtgaggttagctaacgctagctagcctcacctgacgttaggtaaggctacgtagcgtcacctgagattagctaagcctacctagactcacgtgaccttaggtaacgctacgtagcgtcaaagctttacaacgctacacaaaacttataaccgtaatcaccattcattaacttaactactatcacatgcattcatgaattgaaacgagaaggatgtaaatagttgggaagttatctccacgttgaagagatcgttagcgagagctgaaagaccgagggaggagacgccgtcaacacggacagagtcgtcgaccctcacatgaagtaggaggaatctccgtgaggagccagagagacgtctttggtcttcggtttcgatccttgatctgacggagaagacgagagaagtgcgactggactccgtgaggaccaacagagtcgtcctcggtttcgatcgtcggtattggtggagaaggcggaggaatctccgtgacgagccagagagatgtcgtcggtcttcggtttcgatccttgatctgacggagaagacgagagaagtgcgacgagactccgtgaggaccaacagagttgtcctcggtttcgatcgtcggtttcggcggagaaggcggaggaatctccgtgaggagccagagagacgtcgttggtcttcggtttcgatccttgatctgttggagaagacgagacaagtgggacgagactcaacgacggagtcagagacgtcgtcggtcttcggtttcggccgagaaggcggagtcggtcttcggtttcggccgagaaggcggaggagacgtcttcgatttgggtctctcctcttgacgaagaaaacaaagaacacgagaaataatgagaaagagaacaaaagaaaaaaaaataaaaataaaaataaaatttggtcctcttatgtggtgacacgtggtttgaaacccaccaaataatcgatcacaaaaaacctaagttaaggatcggtaataacctttctaattaattttgatttatattaaatcactctttttatttataaaccccactaaattatgcgatattgattgtctaagtacaaaaattctctcgaattcaatacacatgtttcatatatttagccctgttcatttaatattactagcgcatttttaatttaaaattttgtaaacttttttggtcaaagaacatttttttaattagagacagaaatctagactctttatttggaataatagtaataaagatatattaggcaatgagtttatgatgttatgtttatatagtttatttcattttaaattgaaaagcattatttttatcgaaatgaatctagtatacaatcaatatttatgttttttcatcagatactttcctattttttggcacctttcatcggactactgatttatttcaatgtgtatgcatgcatgagcatgagtatacacatgtcttttaaaatgcatgtaaagcgtaacggaccacaaaagaggatccatacaaatacatctcatcgcttcctctactattctccgacacacacactgagcatggtgcttaaacactctggtgagttctagtacttctgctatgatcgatctcattaccatttcttaaatttctctccctaaatattccgagttcttgatttttgataacttcaggttttctctttttgataaatctggtctttccatttttttttttttgtggttaatttagtttcctatgttcttcgattgtattatgcatgatctgtgtttggattctgttagattatgtattggtgaatatgtatgtgtttttgcatgtctggttttggtcttaaaaatgttcaaatctgatgatttgattgaagcttttttagtgttggtttgattcttctcaaaactactgttaatttactatcatgttttccaactttgattcatgatgacacttttgttctgctttgttataaaattttggttggtttgattttgtaattatagtgtaattttgttaggaatgaacatgttttaatactctgttttcgatttgtcacacattcgaattattaatcgataatttaactgaaaattcatggttctagatcttgttgtcatcagattatttgtttcgataattcatcaaatatgtagtccttttgctgatttgcgactgtttcattttttctcaaaattgttttttgttaagtttatctaacagttatcgttgtcaaaagtctctttcattttgcaaaatcttctttttttttttgtttgtaactttgttttttaagctacacatttagtctgtaaaatagcatcgaggaacagttgtcttagtagacttgcatgttcttgtaacttctatttgtttcagtttgttgatgactgctttgattttgtaggtcaaaccgcgccatgtctgctagcggagctttgttgcctgctatagctttcgctgcttacgcttacgctacctacgcttatgctttcgagtggagccacgctaacggaatcgataacgtggatgctagagagtggattggagctttgtctttgagactccctgcaattgcaaccacaatgtacctcttgttctgccttgtgggacctagattgatggctaagagggaggcttttgatcctaagggatttatgctcgcttacaacgcttaccaaaccgctttcaacgttgtggtgctcggaatgttcgctagagagatctctggattgggacaacctgtttggggatctactatgccttggagcgataggaagtccttcaagattttgttgggagtgtggctccactacaacaataagtacctcgagttgttggatactgtgttcatggtggctaggaaaaagaccaagcagctctctttcttgcacgtgtaccaccacgctttgttgatttgggcttggtggcttgtttgtcacctcatggctaccaacgattgcatcgatgcttatttcggagctgcttgcaactctttcatccacatcgtgatgtactcctactacctcatgtctgctttgggaattaggtgcccttggaagagatatatcacccaggctcagatgttgcaattcgtgatcgtgttcgctcacgctgttttcgtgctcagacaaaagcactgccctgttactttgccttgggcacaaatgttcgtgatgacaaatatgttggtgctcttcggaaacttctacctcaaggcttactctaacaagtctaggggagatggagcttcttctgttaagcctgctgagactactagagcaccttctgtgagaagaaccaggtcaaggaagatcgattgatagttaatgaactaagtttgatgtatctgagtgccaacgtttactttgtctttcctttcttttattggttatgattagatgtttactatgttctctctttttcgttataaataaagaagttcaattcttctatagtttcaaacgcgattttaagcgtttctatttaggtttacatgatttcttttacaaaatcatctttaaaatacagtatatttttagttttcataaaatatttaaagaaatgaaagtttataaacattcactcctattctctaattaaggatttgtaaaacaaaaattttgtaagcatatcgatttatgcgttttgtcttaattagctcactaaataataaataatagcttatgttgtgggactgtttaattacctaacttagaactaaaatcaactctttgtgctagctagcctcagctgacgttacgtaacgctaggtagcgtcacgtgacgttagctaacgctaggtagcgtcagctgagcttacgtaagcgcttaattaaagtactgatatcggtaccaaatcgaatccaaaaattacggatatgaatataggcatatccgtatccgaattatccgtttgacagctagcaacgattgtacaattgcttctttaaaaaaggaagaaagaaagaaagaaaagaatcaacatcagcgttaacaaacggccccgttacggcccaaacggtcatatagagtaacggcgttaagcgttgaaagactcctatcgaaatacgtaaccgcaaacgtgtcatagtcagatcccctcttccttcaccgcctcaaacacaaaaataatcttctacagcctatatatacaacccccccttctatctctcctttctcacaattcatcatctttctttctctacccccaattttaagaaatcctctcttctcctcttcattttcaaggtaaatctctctctctctctctctctctgttattccttgttttaattaggtatgtattattgctagtttgttaatctgcttatcttatgtatgccttatgtgaatatctttatcttgttcatctcatccgtttagaagctataaatttgttgatttgactgtgtatctacacgtggttatgtttatatctaatcagatatgaatttcttcatattgttgcgtttgtgtgtaccaatccgaaatcgttgatttttttcatttaatcgtgtagctaattgtacgtatacatatggatctacgtatcaattgttcatctgtttgtgtttgtatgtatacagatctgaaaacatcacttctctcatctgattgtgttgttacatacatagatatagatctgttatatcattttttttattaattgtgtatatatatatgtgcatagatctggattacatgattgtgattatttacatgattttgttatttacgtatgtatatatgtagatctggactttttggagttgttgacttgattgtatttgtgtgtgtatatgtgtgttctgatcttgatatgttatgtatgtgcagctgaaccatggcggcggcaacaacaacaacaacaacatcttcttcgatctccttctccaccaaaccatctccttcctcctccaaatcaccattaccaatctccagattctccctcccattctccctaaaccccaacaaatcatcctcctcctcccgccgccgcggtatcaaatccagctctccctcctccatctccgccgtgctcaacacaaccaccaatgtcacaaccactccctctccaaccaaacctaccaaacccgaaacattcatctcccgattcgctccagatcaaccccgcaaaggcgctgatatcctcgtcgaggctttagaacgtcaaggcgtagaaaccgtattcgcttaccctggaggtacatcaatggagattcaccaagccttaacccgctcttcctcaatccgtaacgtccttcctcgtcacgaacaaggaggtgtattcgcagcagaaggatacgctcgatcctcaggtaaaccaggtatctgtatagccacttcaggtcccggagctacaaatctcgttagcggattagccgatgcgttgttagatagtgttcctcttgtagcaatcacaggacaagtccctcgtcgtatgattggtacagatgcgtttcaagagactccgattgttgaggtaacgcgttcgattacgaagcataactatcttgtgatggatgttgaagatatcccaaggattattgaagaggctttctttttagctacttctggtagacctggacctgttttggttgatgttcctaaagatattcaacaacagcttgcgattcctaattgggaacaggctatgagattacctggttatatgtctaggatgcctaaacctccggaagattctcatttggagcagattgttaggttgatttctgagtctaagaagcctgtgttgtatgttggtggtggttgtcttaattctagcgatgaattgggtaggtttgttgagcttacgggcatccctgttgcgagtacgttgatggggctgggatcttatccttgtgatgatgagttgtcgttacatatgcttggaatgcatgggactgtgtatgcaaattacgctgtggagcatagtgatttgttgttggcgtttggggtaaggtttgatgatcgtgtcacgggtaaacttgaggcttttgctagtagggctaagattgttcatattgatattgactcggctgagattgggaagaataagactcctcatgtgtctgtgtgtggtgatgttaagctggctttgcaagggatgaataaggttcttgagaaccgagcggaggagcttaaacttgattttggagtttggaggaatgagttgaacgtacagaaacagaagtttccgttgagctttaagacgtttggggaagctattcctccacagtatgcgattaaggtccttgatgagttgactgatggaaaagccataataagtactggtgtcgggcaacatcaaatgtgggcggcgcagttctacaattacaagaaaccaaggcagtggctatcatcaggaggccttggagctatgggatttggacttcctgctgcgattggagcgtctgttgctaaccctgatgcgatagttgtggatattgacggagatggaagttttataatgaatgtgcaagagctagccactattcgtgtagagaatcttccagtgaaggtacttttattaaacaaccagcatcttggcatggttatgcaatgggaagatcggttctacaaagctaaccgagctcacacatttctcggggacccggctcaggaggacgagatattcccgaacatgttgctgtttgcagcagcttgcgggattccagcggcgagggtgacaaagaaagcagatctccgagaagctattcagacaatgctggatacaccaggaccttacctgttggatgtgatttgtccgcaccaagaacatgtgttgccgatgatcccgaatggtggcactttcaacgatgtcataacggaaggagatggccggattaaatactgagagatgaaaccggtgattatcagaaccttttatggtctttgtatgcatatggtaaaaaaacttagtttgcaatttcctgtttgttttggtaatttgagtttcttttagttgttgatctgcctgctttttggtttacgtcagactactactgctgttgttgtttggtttcctttctttcattttataaataaataatccggttcggtttactccttgtgactggctcagtttggttattgcgaaatgcgaatggtaaattgagtaattgaaattcgttattagggttctaagctgttttaacagtcactgggttaatatctctcgaatcttgcatggaaaatgctcttaccattggtttttaattgaaatgtgctcatatgggccgtggtttccaaattaaataaaactacgatgtcatcgagaagtaaaatcaactgtgtccacattatcagttttgtgtatacgatgaaatagggtaattcaaaatctagcttgatatgccttttggttcattttaaccttctgtaaacattttttcagattttgaacaagtaaatccaaaaaaaaaaaaaaaaatctcaactcaacactaaattattttaatgtataaaagatgcttaaaacatttggcttaaaagaaagaagctaaaaacatagagaactcttgtaaattgaagtatgaaaatatactgaattgggtattatatgaatttttctgatttaggattcacatgatccaaaaaggaaatccagaagcactaatcagacattggaagtaggattaatcagtgatcagtaactattaaattcaattaaccgcggacatctacatttttgaattgaaaaaaaattggtaattactctttctttttctccatattgaccatcatactcattgctgatccatgtagatttcccggacatgaagccatttacaattgaatatatcctcacatatgaaatatattttttttttacaaattacacctattaaattatacttgatcggtcatctgatatatttgaaagaaccctatcagccagctattcataatttacataaaagaaaattacgtgcttaaaatctctctaaaaaaaaaaaaagacaaagacatcaaactgatccatgaaagtaaaatggagtgtattttaattttatcttcagaccaatgttatcaatgtagcccatatattaatactaaaacaacttctgcacaaacacacgaatcaaagcctcgtgtttcatcgtagctttagctaaaatttcccaaaagcaaattcaatagtattttactaggtcaaacccacaagagaaaaagaaagtcaatcccaaggatcaagaaatgagaagtgagaggagaatgctttattgggtttgctaataactaataagacatgaagcagactgaaaacatctggttttgtccaaaaaagaaggaagtcagattccaaaactgcgcacctacattgtttaatactcactcacacatacattcatgtttttactgtttatacacagtcaataatttatacacagctccatgttttaatatttacccatctctcttttgtagtctatcgtagactttcacttgtgtccccctcatgcggcaacatcctcagcaacttgatttactatatacaataatacaaatcataagatatttgttaggagctggtttgtaaattatttcgatacaatactgaagcgaagggaccagcaatctttttagctgatcagaacaatcttactaacgtgtgtctttgtaagaaaatccaacttttactttttcaggagggagtgtagcggattatgtataaataactcgaagagtggtgcacaaagttcaagtgtttgtgtaaaatgttcgacaagacattgactaaagcattccgaacatgtcaacaaaactacaattctaaaattgcaaaaagctgctaaacggtggaatagcatttaacacgcattctataccaaacattttttttcttgaacaccaaagaaaccaaacctaatgtcaaccatcgtatggaaactatagaactaaatcaaactaacaaattcttattgtatattcttaaaaacatccttataagacagtttttccaaatgaatctttagacttcattgtactaatatgtttaaaataatataattatgtatttaatttcttgaaagtttcgctgctaagaggcaattatctttttatatttttttctctcttattttcaaattctaattaattttcttggagagtttatccgatgatgatattcttatttcaactcaatccacgagtaaatgtgttagcaccacatctaaccatttggagcttgtactagctctatctttccaaacttaactttcttgagtgcttatttatataaagcatcagtatatggcccaacccaagaaaagctgaacaaaattagcaacaatagcaagggacgaactgcagctcttcttggttgtcgtgccttccaattctcgactttccgtggaagaacat

SEQ ID NO: 290 - DNA, 43773 bp, Artificial sequence
  T-DNA insertion in LBFLFK Locus 2, including left and right border sequences
ccagtcagcatcatcacaccaaaagttaggcccgaatagtttgaaattagaaagctcgcaattgaggtctacaggccaaattcgctcttagccgtacaatattactcaccggtgcgatgccccccatcgtaggtgaaggtggaaattaatggcgcgcctgatcactgattagtaactattacgtaagcctacgtagcgtcacgtgacgttagctaacgctacgtagcctcagctgacgttacgtaagcctacgtagcgtcacgtgagcttagctaacgctacctaggctcagctgacgttacgtaacgctagctagcgtcactcctgcagcaaatttacacattgccactaaacgtctaaacccttgtaatttgtttttgttttactatgtgtgttatgtatttgatttgcgataaatttttatatttggtactaaatttataacaccttttatgctaacgtttgccaacacttagcaatttgcaagttgattaattgattctaaattatttttgtcttctaaatacatatactaatcaactggaaatgtaaatatttgctaatatttctactataggagaattaaagtgagtgaatatggtaccacaaggtttggagatttaattgttgcaatgctgcatggatggcatatacaccaaacattcaataattcttgaggataataatggtaccacacaagatttgaggtgcatgaacgtcacgtggacaaaaggtttagtaatttttcaagacaacaatgttaccacacacaagttttgaggtgcatgcatggatgccctgtggaaagtttaaaaatattttggaaatgatttgcatggaagccatgtgtaaaaccatgacatccacttggaggatgcaataatgaagaaaactacaaatttacatgcaactagttatgcatgtagtctatataatgaggattttgcaatactttcattcatacacactcactaagttttacacgattataatttcttcatagccagtactgtttaagcttcactgtctctgaatcggcaaaggtaaacgtatcaattattctacaaacccttttatttttcttttgaattaccgtcttcattggttatatgataacttgataagtaaagcttcaataattgaatttgatctgtgtttttttggccttaatactaaatccttacataagctttgttgcttctcctcttgtgagttgagtgttaagttgtaataatggttcactttcagctttagaagaaaccatggaagttgttgagaggttctacggagagttggatggaaaggtttcccaaggagtgaacgctttgttgggatctttcggagttgagttgactgataccccaactactaagggattgccactcgttgattctccaactccaattgtgttgggagtgtctgtttacttgaccatcgtgatcggaggattgctttggatcaaggctagagatctcaagccaagagcttctgagccattcttgttgcaagctttggtgttggtgcacaacttgttctgcttcgctttgtctctttacatgtgcgtgggtatcgcttaccaagctatcacctggagatattccttgtggggaaacgcttataacccaaagcacaaggagatggctatcctcgtttacctcttctacatgtccaagtacgtggagttcatggataccgtgatcatgatcctcaagagatccaccagacagatttctttcctccacgtgtaccaccactcttctatctcccttatctggtgggctattgctcaccacgctccaggaggagaggcttattggagtgctgctctcaactctggagtgcacgtgttgatgtacgcttactacttcttggctgcttgcttgagatcttccccaaagctcaagaacaagtacctcttctggggaagatacctcacccaattccagatgttccagttcatgctcaacttggtgcaagcttactacgatatgaaaaccaacgctccatatccacaatggctcatcaagatcctcttctactacatgatctccctcttgttcctcttcggaaacttctacgtgcaaaagtacatcaagccatccgatggaaagcaaaagggagctaagaccgagtgatcgacaagctcgagtttctccataataatgtgtgagtagttcccagataagggaattagggttcctatagggtttcgctcatgtgttgagcatataagaaacccttagtatgtatttgtatttgtaaaatacttctatcaataaaatttctaattcctaaaaccaaaatccagtactaaaatccagatcccccgaattaattcggcgttaattcagctagctagcctcagctgacgttacgtaacgctaggtagcgtcacgtgacgttagctaacgctaggtagcgtcagctgagcttacgtaagcgcttagcagatatttggtgtctaaatgtttattttgtgatatgttcatgtttgaaatggtggtttcgaaaccagggacaacgttgggatctgatagggtgtcaaagagtattatggattgggacaatttcggtcatgagttgcaaattcaagtatatcgttcgattatgaaaattttcgaagaatatcccatttgagagagtctttacctcattaatgtttttagattatgaaattttatcatagttcatcgtagtctttttggtgtaaaggctgtaaaaagaaattgttcacttttgttttcgtttatgtgaaggctgtaaaagattgtaaaagactattttggtgttttggataaaatgatagtttttatagattcttttgcttttagaagaaatacatttgaaattttttccatgttgagtataaaataccgaaatcgattgaagatcatagaaatattttaactgaaaacaaatttataactgattcaattctctccatttttatacctatttaaccgtaatcgattctaatagatgatcgattttttatataatcctaattaaccaacggcatgtattggataattaaccgatcaactctcacccctaatagaatcagtattttccttcgacgttaattgatcctacactatgtaggtcatatccatcgttttaatttttggccaccattcaattctgtcttgcctttagggatgtgaatatgaacggccaaggtaagagaataaaaataatccaaattaaagcaagagaggccaagtaagataatccaaatgtacacttgtcattgccaaaattagtaaaatactcggcatattgtattcccacacattattaaaataccgtatatgtattggctgcatttgcatgaataatactacgtgtaagcccaaaagaacccacgtgtagcccatgcaaagttaacactcacgaccccattcctcagtctccactatataaacccaccatccccaatctcaccaaacccaccacacaactcacaactcactctcacaccttaaagaaccaatcaccaccaaaaaatttcacgatttggaatttgattcctgcgatcacaggtatgacaggttagattttgttttgtatagttgtatacatacttctttgtgatgttttgtttacttaatcgaatttttggagtgttttaaggtctctcgtttagaaatcgtggaaaatatcactgtgtgtgtgttcttatgattcacagtgtttatgggtttcatgttctttgttttatcattgaatgggaagaaatttcgttgggatacaaatttctcatgttcttactgatcgttattaggagtttggggaaaaaggaagagtttttttggttggttcgagtgattatgaggttatttctgtatttgatttatgagttaatggtcgttttaatgttgtagaccatgggaaaaggatctgagggaagatctgctgctagagagatgactgctgaggctaacggagataagagaaagaccatcctcattgagggagtgttgtacgatgctaccaacttcaaacacccaggaggttccattattaacttcctcaccgagggagaagctggagttgatgctacccaagcttacagagagttccatcagagatccggaaaggctgataagtacctcaagtccctcccaaagttggatgcttctaaggtggagtctaggttctctgctaaggagcaggctagaagggacgctatgaccagggattacgctgctttcagagaggagttggttgctgagggatacttcgatccatctatcccacacatgatctacagagtggtggagattgtggctttgttcgctttgtctttctggttgatgtctaaggcttctccaacctctttggttttgggagtggtgatgaacggaatcgctcaaggaagatgcggatgggttatgcacgagatgggacacggatctttcactggagttatctggctcgatgataggatgtgcgagttcttctacggagttggatgtggaatgtctggacactactggaagaaccagcactctaagcaccacgctgctccaaacagattggagcacgatgtggatttgaacaccttgccactcgttgctttcaacgagagagttgtgaggaaggttaagccaggatctttgttggctttgtggctcagagttcaggcttatttgttcgctccagtgtcttgcttgttgatcggattgggatggaccttgtacttgcacccaagatatatgctcaggaccaagagacacatggagtttgtgtggatcttcgctagatatatcggatggttctccttgatgggagctttgggatattctcctggaacttctgtgggaatgtacctctgctctttcggacttggatgcatctacatcttcctccaattcgctgtgtctcacacccacttgccagttaccaacccagaggatcaattgcactggcttgagtacgctgctgatcacaccgtgaacatctctaccaagtcttggttggttacctggtggatgtctaacctcaacttccaaatcgagcaccacttgttcccaaccgctccacaattcaggttcaaggagatctctccaagagttgaggctctcttcaagagacacaacctcccttactacgatttgccatacacctctgctgtttctactaccttcgctaacctctactctgttggacactctgttggagctgataccaagaagcaggattgactgctttaatgagatatgcgagacgcctatgatcgcatgatatttgctttcaattctgttgtgcacgttgtaaaaaacctgagcatgtgtagctcagatccttaccgccggtttcggttcattctaatgaatatatcacccgttactatcgtatttttatgaataatattctccgttcaatttactgattgtctacgtaggctcagctgagcttacctaaggctacgtaggctcacgtgacgttacgtaaggctacgtagcgtcacgtgagcttacctaactctagctagcctcacgtgaccttagctaacactaggtagcgtcagctcgacggcccggactgtatccaacttctgatctttgaatctctctgttccaacatgttctgaaggagttctaagacttttcagaaagcttgtaacatgctttgtagactttctttgaattactcttgcaaactctgattgaacctacgtgaaaactgctccagaagttctaaccaaattccgtcttgggaaggcccaaaatttattgagtacttcagtttcatggacgtgtcttcaaagatttataacttgaaatcccatcatttttaagagaagttctgttccgcaatgtcttagatctcattgaaatctacaactcttgtgtcagaagttcttccagaatcaacttgcatcatggtgaaaatctggccagaagttctgaacttgtcatatttcttaacagttagaaaaatttctaagtgtttagaattttgacttttccaaagcaaacttgacttttgactttcttaataaaacaaacttcatattctaacatgtcttgatgaaatgtgattcttgaaatttgatgttgatgcaaaagtcaaagtttgacttttcagtgtgcaattgaccattttgctcttgtgccaattccaaacctaaattgatgtatcagtgctgcaaacttgatgtcatggaagatcttatgagaaaattcttgaagactgagaggaaaaattttgtagtacaacacaaagaatcctgtttttcatagtcggactagacacattaacataaaacaccacttcattcgaagagtgattgaagaaggaaatgtgcagttacctttctgcagttcataagagcaacttacagacacttttactaaaatactacaaagaggaagattttaacaacttagagaagtaatgggagttaaagagcaacacattaagggggagtgttaaaattaatgtgttgtaaccaccactacctttagtaagtattataagaaaattgtaatcatcacattataattattgtccttatttaaaattatgataaagttgtatcattaagattgagaaaaccaaatagtcctcgtcttgatttttgaattattgttttctatgttacttttcttcaagcctatataaaaactttgtaatgctaaattgtatgctggaaaaaaatgtgtaatgaattgaatagaaattatggtatttcaaagtccaaaatccatcaatagaaatttagtacaaaacgtaactcaaaaatattctcttattttaaattttacaacaatataaaaatattctcttattttaaattttacaataatataatttatcacctgtcacctttagaataccaccaacaatattaatacttagatattttattcttaataattttgagatctctcaatatatctgatatttattttatatttgtgtcatattttcttatgttttagagttaacccttatatcttggtcaaactagtaattcaatatatgagtttgtgaaggacacattgacatcttgaaacattggttttaaccttgttggaatgttaaaggtaataaaacattcagaattatgaccatctattaatatacttcctttgtcttttaaaaaagtgtgcatgaaaatgctctatggtaagctagagtgtcttgctggcctgtgtatatcaattccatttccagatggtagaaactgccactacgaataattagtcataagacacgtatgttaacacacgtccccttgcatgttttttgccatatattccgtctctttctttttcttcacgtataaaacaatgaactaattaatagagcgatcaagctgaacagttctttgctttcgaagttgccgcaacctaaacaggtttttccttcttctttcttcttattaactacgaccttgtcctttgcctatgtaaaattactaggttttcatcagttacactgattaagttcgttatagtggaagataaaatgccctcaaagcattttgcaggatatctttgatttttcaaagatatggaactgtagagtttgatagtgttcttgaatgtggttgcatgaagtttttttggtctgcatgttattttttcctcgaaatatgttttgagtccaacaagtgattcacttgggattcagaaagttgttttctcaatatgtaacagtttttttctatggagaaaaatcatagggaccgttggttttggcttctttaattttgagctcagattaaacccattttacccggtgttcttggcagaattgaaaacagtacgtagtaccgcgcctaccatgtgtgttgagaccgagaacaacgatggaatccctactgtggagatcgctttcgatggagagagagaaagagctgaggctaacgtgaagttgtctgctgagaagatggaacctgctgctttggctaagaccttcgctagaagatacgtggttatcgagggagttgagtacgatgtgaccgatttcaaacatcctggaggaaccgtgattttctacgctctctctaacactggagctgatgctactgaggctttcaaggagttccaccacagatctagaaaggctaggaaggctttggctgctttgccttctagacctgctaagaccgctaaagtggatgatgctgagatgctccaggatttcgctaagtggagaaaggagttggagagggacggattcttcaagccttctcctgctcatgttgcttacagattcgctgagttggctgctatgtacgctttgggaacctacttgatgtacgctagatacgttgtgtcctctgtgttggtttacgcttgcttcttcggagctagatgtggatgggttcaacacgagggaggacactcttctttgaccggaaacatctggtgggataagagaatccaagctttcactgctggattcggattggctggatctggagatatgtggaactccatgcacaacaagcaccacgctactcctcaaaaagtgaggcacgatatggatttggataccactcctgctgttgctttcttcaacaccgctgtggaggataatagacctaggggattctctaagtactggctcagattgcaagcttggaccttcattcctgtgacttctggattggtgttgctcttctggatgttcttcctccacccttctaaggctttgaagggaggaaagtacgaggagcttgtgtggatgttggctgctcacgtgattagaacctggaccattaaggctgttactggattcaccgctatgcaatcctacggactcttcttggctacttcttgggtttccggatgctacttgttcgctcacttctctacttctcacacccacttggatgttgttcctgctgatgagcacttgtcttgggttaggtacgctgtggatcacaccattgatatcgatccttctcagggatgggttaactggttgatgggatacttgaactgccaagtgattcaccacctcttcccttctatgcctcaattcagacaacctgaggtgtccagaagattcgttgctttcgctaagaagtggaacctcaactacaaggtgatgacttatgctggagcttggaaggctactttgggaaacctcgataatgtgggaaagcactactacgtgcacggacaacactctggaaagaccgcttgattaatgaaggccgcctcgaccgtaccccctgcagatagactatactatgttttagcctgcctgctggctagctactatgttatgttatgttgtaaaataaacacctgctaaggtatatctatctatattttagcatggctttctcaataaattgtctttccttatcgtttactatcttatacctaataatgaaataataatatcacatatgaggaacggggcaggtttaggcatatatatacgagtgtagggcggagtggggctacgtagcgtcacgtgacgttacctaagcctaggtagcctcagctgacgttacgtaacgctaggtaggctcagctgacacgggcaggacatagggactactacaagcatagtatgcttcagacaaagagctaggaaagaactcttgatggaggttaagagaaaaaagtgctagaggggcatagtaatcaaacttgtcaaaaccgtcatcatgatgagggatgacataatataaaaagttgactaaggtcttggtagtactctttgattagtattatatattggtgagaacatgagtcaagaggagacaagaaaccgaggaaccatagtttagcaacaagatggaagttgcaaagttgagctagccgctcgattagttacatctcctaagcagtactacaaggaatggtctctatactttcatgtttagcacatggtagtgcggattgacaagttagaaacagtgcttaggagacaaagagtcagtaaaggtattgaaagagtgaagttgatgctcgacaggtcaggagaagtccctccgccagatggtgactaccaaggggttggtatcagctgagacccaaataagattcttcggttgaaccagtggttcgaccgagactcttagggtgggatttcactgtaagatttgtgcattttgttgaatataaattgacaattttttttatttaattatagattatttagaatgaattacatatttagtttctaacaaggatagcaatggatgggtatgggtacaggttaaacatatctattacccacccatctagtcgtcgggttttacacgtacccacccgtttacataaaccagaccggaattttaaaccgtacccgtccgttagcgggtttcagatttacccgtttaatcgggtaaaacctgattactaaatatatattttttatttgataaacaaaacaaaaatgttaatattttcatattggatgcaattttaagaaacacatattcataaatttccatatttgtaggaaaataaaaagaaaaatatattcaagaacacaaatttcaccgacatgacttttattacagagttggaattagatctaacaattgaaaaattaaaattaagatagaatatgttgaggaacatgacatagtataatgctgggttacccgtcgggtaggtatcgaggcggatactactaaatccatcccactcgctatccgataatcactggtttcgggtatacccattcccgtcaacaggcctttttaaccggataatttcaacttatagtgaatgaattttgaataaatagttagaataccaaaatcctggattgcatttgcaatcaaattttgtgaaccgttaaattttgcatgtacttgggatagatataatagaaccgaattttcattagtttaatttataacttactttgttcaaagaaaaaaaatatctatccaatttacttataataaaaaataatctatccaagttacttattataatcaacttgtaaaaaggtaagaatacaaatgtggtagcgtacgtgtgattatatgtgacgaaatgttatatctaacaaaagtccaaattcccatggtaaaaaaaatcaaaatgcatggcaggctgtttgtaaccttggaataagatgttggccaattctggagccgccacgtacgcaagactcagggccacgttctcttcatgcaaggatagtagaacaccactccacccacctcctatattagacctttgcccaaccctccccaactttcccatcccatccacaaagaaaccgacatttttatcataaatctggtgcttaaacactctggtgagttctagtacttctgctatgatcgatctcattaccatttcttaaatttctctccctaaatattccgagttcttgatttttgataacttcaggttttctctttttgataaatctggtctttccattttttttttttgtggttaatttagtttcctatgttcttcgattgtattatgcatgatctgtgtttggattctgttagattatgtattggtgaatatgtatgtgtttttgcatgtctggttttggtcttaaaaatgttcaaatctgatgatttgattgaagcttttttagtgttggtttgattcttctcaaaactactgttaatttactatcatgttttccaactttgattcatgatgacacttttgttctgctttgttataaaattttggttggtttgattttgtaattatagtgtaattttgttaggaatgaacatgttttaatactctgttttcgatttgtcacacattcgaattattaatcgataatttaactgaaaattcatggttctagatcttgttgtcatcagattatttgtttcgataattcatcaaatatgtagtccttttgctgatttgcgactgtttcattttttctcaaaattgttttttgttaagtttatctaacagttatcgttgtcaaaagtctctttcattttgcaaaatcttctttttttttttgtttgtaactttgttttttaagctacacatttagtctgtaaaatagcatcgaggaacagttgtcttagtagacttgcatgttcttgtaacttctatttgtttcagtttgttgatgactgctttgattttgtaggtcaaaggcgcaccctaccatggatgcttataacgctgctatggataagattggagctgctatcatcgattggagtgatccagatggaaagttcagagctgatagggaggattggtggttgtgcgatttcagatccgctatcaccattgctctcatctacatcgctttcgtgatcttgggatctgctgtgatgcaatctctcccagctatggacccataccctatcaagttcctctacaacgtgtctcaaatcttcctctgcgcttacatgactgttgaggctggattcctcgcttataggaacggatacaccgttatgccatgcaaccacttcaacgtgaacgatccaccagttgctaacttgctctggctcttctacatctccaaagtgtgggatttctgggataccatcttcattgtgctcggaaagaagtggagacaactctctttcttgcacgtgtaccaccacaccaccatcttcctcttctactggttgaacgctaacgtgctctacgatggagatatcttcttgaccatcctcctcaacggattcattcacaccgtgatgtacacctactacttcatctgcatgcacaccaaggattctaagaccggaaagtctttgccaatctggtggaagtcatctttgaccgctttccaactcttgcaattcaccatcatgatgtcccaagctacctacttggttttccacggatgcgataaggtttccctcagaatcaccatcgtgtacttcgtgtacattctctcccttttcttcctcttcgctcagttcttcgtgcaatcctacatggctccaaagaagaagaagtccgcttgatgttaatgaaggccgcagatatcagatctggtcgacctagaggatccccggccgcaaagataataacaaaagcctactatataacgtacatgcaagtattgtatgatattaatgtttttacgtacgtgtaaacaaaaataattacgtttgtaacgtatggtgatgatgtggtgcactaggtgtaggccttgtattaataaaaagaagtttgttctatatagagtggtttagtacgacgatttatttactagtcggattggaatagagaaccgaattcttcaatccttgcttttgatcaagaattgaaaccgaatcaaatgtaaaagttgatatatttgaaaaacgtattgagcttatgaaaatgctaatactctcatctgtatggaaaagtgactttaaaaccgaacttaaaagtgacaaaaggggaatatcgcatcaaaccgaatgaaaccgatctacgtaggctcagctgagcttagctaagcctacctagcctcacgtgagattatgtaaggctaggtagcgtcacgtgacgttacctaacactagctagcgtcagctgagcttagctaaccctacgtagcctcacgtgagcttacctaacgctacgtagcctcacgtgactaaggatgacctacccattcttgagacaaatgttacattttagtatcagagtaaaatgtgtacctataactcaaattcgattgacatgtatccattcaacataaaattaaaccagcctgcacctgcatccacatttcaagtattttcaaaccgttcggctcctatccaccgggtgtaacaagacggattccgaatttggaagattttgactcaaattcccaatttatattgaccgtgactaaatcaactttaacttctataattctgattaagctcccaatttatattcccaacggcactacctccaaaatttatagactctcatccccttttaaaccaacttagtaaacgttttttttttaattttatgaagttaagtttttaccttgtttttaaaaagaatcgttcataagatgccatgccagaacattagctacacgttacacatagcatgcagccgcggagaattgtttttcttcgccacttgtcactcccttcaaacacctaagagcttctctctcacagcacacacatacaatcacatgcgtgcatgcattattacacgtgatcgccatgcaaatctcctttatagcctataaattaactcatcggcttcactctttactcaaaccaaaactcatcaatacaaacaagattaaaaacatttcacgatttggaatttgattcctgcgatcacaggtatgacaggttagattttgttttgtatagttgtatacatacttctttgtgatgttttgtttacttaatcgaatttttggagtgttttaaggtctctcgtttagaaatcgtggaaaatatcactgtgtgtgtgttcttatgattcacagtgtttatgggtttcatgttctttgttttatcattgaatgggaagaaatttcgttgggatacaaatttctcatgttcttactgatcgttattaggagtttggggaaaaaggaagagtttttttggttggttcgagtgattatgaggttatttctgtatttgatttatgagttaatggtcgttttaatgttgtagaccgccatggctattttgaaccctgaggctgattctgctgctaacctcgctactgattctgaggctaagcaaagacaattggctgaggctggatacactcacgttgagggtgctcctgctcctttgcctttggagttgcctcacttctctctcagagatctcagagctgctattcctaagcactgcttcgagagatctttcgtgacctccacctactacatgatcaagaacgtgttgacttgcgctgctttgttctacgctgctaccttcattgatagagctggagctgctgcttatgttttgtggcctgtgtactggttcttccagggatcttacttgactggagtgtgggttatcgctcacgagtgtggacaccaggcttattgctcttctgaggtggtgaacaacttgattggactcgtgttgcactctgctttgttggtgccttaccactcttggagaatctctcacagaaagcaccactccaacactggatcttgcgagaacgatgaggttttcgttcctgtgaccagatctgtgttggcttcttcttggaacgagaccttggaggattctcctctctaccaactctaccgtatcgtgtacatgttggttgttggatggatgcctggatacctcttcttcaacgctactggacctactaagtactggggaaagtctaggtctcacttcaacccttactccgctatctatgctgatagggagaggtggatgatcgtgctctccgatattttcttggtggctatgttggctgttttggctgctttggtgcacactttctccttcaacacgatggtgaagttctacgtggtgccttacttcattgtgaacgcttacttggtgttgattacctacctccaacacaccgatacctacatccctcacttcagagagggagagtggaattggttgagaggagctttgtgcactgtggatagatcatttggtccattcctcgattctgtggtgcatagaatcgtggatacccacgtttgccaccatatcttctccaagatgcctttctatcactgcgaggaggctaccaacgctattaagcctctcctcggaaagttctacttgaaggatactactcctgttcctgttgctctctggagatcttacacccactgcaagttcgttgaggatgatggaaaggtggtgttctacaagaacaagttatagttaatgaataattgattggttcgagtattatggcattgggaaaactgtttttcttgtaccatttgttgtgcttgtaatttactgtgttttttattcggttttcgctatcgaactgtgaaatggaaatggatggagaagagttaatgaatgatatggtccttttgttcattctcaaattaatattatttgttttttctcttatttgttgtgtgttgaatttgaaattataagagatatgcaaacattttgttttgagtaaaaatgtgtcaaatcgtggcctctaatgaccgaagttaatatgaggagtaaaacacttgtagttgtaccattatgcttattcactaggcaacaaatatattttcagacctagaaaagctgcaaatgttactgaatacaagtatgtcctcttgtgttttagacatttatgaactttcctttatgtaattttccagaatccttgtcagattctaatcattgctttataattatagttatactcatggatttgtagttgagtatgaaaatattttttaatgcattttatgacttgccaattgattgacaacatgcatcaatctagctagcctcagctgacgttacgtaacgctaggtagcgtcacgtgacgttagctaacgctaggtagcgtcagctgagcttacgtaagcgcacagatgaatactagctgttgttcacagttctagtgtctcctcattacgtgaattcaagctacgatcactatctcaactcctacataaacatcagaatgctacaaaactatgcacaaaaacaaaagctacatctaatacgtgaatcaattactctcatcacaagaaagaagatttcaatcaccgtcgagaaggaggattcagttaattgaatcaaagttccgatcaaactcgaagactggtgagcacgaggacgacgaagaagagtgtctcgaagatacaacaagcaagaaatctactgagtgacctcctgaagttattggcgcgattgagagaatcaatccgaattaatttcggggaaaaagataaattagatactaagcgatgggcttgggctgggctaagaaacaggtggcaattgggctggaggaccccgcgattcatagcttccgatagcccaaaaaaaaacggataacatatttatcgggtatttgaatttcagtgaaataagatattttctttttgttaggaaaattttagaaaataatggaaattaaatagcgattatgttacaagatacgatcagcatcgggcagtgcaaaatgctatagcttcccaagatttgatccttttgggttatctcctaatgacaattagtttaggattttgaaacttatattaatactattatccgacaacacttgtttcagcttcttattttaacattttttgtttttttctattcttcttcccatcagcattttctttttaaaaaattgaatactttaactttttaaaaatttcacaatgatcagatgatattatggaagatctcaagagttaaatgtatccatcttggggcattaaaaccggtgtacgggatgataaatacagactttatatcatatgatagctcagtaattcatatttatcacgttgctaaaaaaattataaggtactagtagtcaacaaaatcaattaaagagaaagaaagaaacgcatgtgaagagagtttacaactggaaaagtaaaataaaaattaacgcatgttgaatgctgacatgtcagtatgtccatgaatccacgtatcaagcgccattcatcgatcgtcttcctctttctaaatgaaaacaacttcacacatcacaacaaacaatacacacaagaccccctctctctcgttgtctctctgccagcgaccaaatcgaagcttgagaagaacaagaaggggtcaaaccatggcttctacatctgctgctcaagacgctgctccttacgagttcccttctctcactgagatcaagagggctcttccttctgagtgtttcgaggcttctgttcctctttctctctactacaccgctagatctcttgctcttgctggatctctcgctgttgctctctcttacgctagagctttgcctcttgttcaggctaacgctcttcttgatgctactctctgcactggatacgttcttctccagggaatcgttttctggggattcttcaccgttggtcacgattgtggacacggagctttctctagatctcacgtgctcaacttctctgttggaaccctcatgcactctatcatccttacccctttcgagtcttggaagctctctcacagacaccaccacaagaacaccggaaacatcgataaggacgagatcttctaccctcaaagagaggctgattctcaccctgtttctagacaccttgtgatgtctcttggatctgcttggttcgcttaccttttcgctggattccctcctagaaccatgaaccacttcaacccttgggaggctatgtatgttagaagagtggctgctgtgatcatctctctcggagttcttttcgctttcgctggactctactcttacctcaccttcgttcttggattcaccactatggctatctactacttcggacctctcttcatcttcgctaccatgcttgttgttaccactttcctccaccacaacgatgaggagacaccttggtacgctgattctgagtggacttacgtgaagggaaacctctcttctgtggacagatcttacggtgctctcatcgacaaccttagccacaacatcggaactcaccagatccaccacctcttccctatcatccctcactacaagctcaacgatgctactgctgctttcgctaaggctttccctgagcttgttaggaaaaacgctgctcctatcatcccaactttcttcaggatggctgctatgtacgctaagtacggagttgttgacactgatgctaagaccttcactctcaaggaggctaaggctgctgctaagactaagtcatcttgatgattaatgaataattgattgtacatactatattttttgtttaccttgtgttagtttaatgttcagtgtcctctctttattgtggcacgtctctttgttgtatgttgtgtctatacaaagttgaaataatggaaagaaaaggaagagtgtaatttgttttgttttaagtgtttataaatatatatatataggtcatttagatagttctaggtttctataaaactctctctctggaagtagaatctgtttttgagaggatccagttgcctactaatctcccccaaaacccttcaagcttaaccttcctcttcacaacaacagaggaaacacatctcttgagctctgagttctcttctttgagcatgtctatcgctaaactcatctgccttatagcttccctcttctcttcatctctctctctcaccatttcgctgtaaaacttattctcctccctcagcctctctatctcttccttcagcatctcacaattcccaccataatcgactgaggatgattcaccgtcatcaacttcagactcagcgttgtagtcgtcatgagtctcacaagccttggaccaagaagactcatcatcgcaagttgatgatttatcatgatgcttctctgagccgtgtttgctacgtagcgtcacgtgacgttacctaagcctaggtagcctcagctgacgttacgtaacgctaggtaggctcagctgactgcagcaaatttacacattgccactaaacgtctaaacccttgtaatttgtttttgttttactatgtgtgttatgtatttgatttgcgataaatttttatatttggtactaaatttataacaccttttatgctaacgtttgccaacacttagcaatttgcaagttgattaattgattctaaattatttttgtcttctaaatacatatactaatcaactggaaatgtaaatatttgctaatatttctactataggagaattaaagtgagtgaatatggtaccacaaggtttggagatttaattgttgcaatgctgcatggatggcatatacaccaaacattcaataattcttgaggataataatggtaccacacaagatttgaggtgcatgaacgtcacgtggacaaaaggtttagtaatttttcaagacaacaatgttaccacacacaagttttgaggtgcatgcatggatgccctgtggaaagtttaaaaatattttggaaatgatttgcatggaagccatgtgtaaaaccatgacatccacttggaggatgcaataatgaagaaaactacaaatttacatgcaactagttatgcatgtagtctatataatgaggattttgcaatactttcattcatacacactcactaagttttacacgattataatttcttcatagccagtactgtttaagcttcactgtctctgaatcggcaaaggtaaacgtatcaattattctacaaacccttttatttttcttttgaattaccgtcttcattggttatatgataacttgataagtaaagcttcaataattgaatttgatctgtgtttttttggccttaatactaaatccttacataagctttgttgcttctcctcttgtgagttgagtgttaagttgtaataatggttcactttcagctttagaagaaacgcgccttccatggctacaaaggaggcttacgttttcccaactctcaccgagatcaagagatctctcccaaaggattgcttcgaggcttctgtgcctttgtctctctactacactgtgagatgcttggttattgctgtggctttgaccttcggattgaactacgctagagctttgccagaggttgagtctttctgggctttggatgctgctttgtgcactggatatatcctcctccagggaattgtgttctggggattcttcactgttggacacgatgctggacacggagctttctctagataccacctcttgaacttcgttgtgggaaccttcatgcactctctcatcttgaccccattcgagtcttggaagttgacccacagacaccaccacaagaacaccggaaacatcgatagagatgaggtgttctacccacagagaaaggctgatgatcacccattgtccaggaacttgatcttggctttgggagctgcttggcttgcttatttggtggagggattcccaccaagaaaggtgaaccacttcaacccattcgagccactttttgtgagacaagtgtccgctgtggttatctctttgctcgctcacttcttcgttgctggactctctatctacttgtctctccagttgggacttaagaccatggctatctactactacggaccagttttcgtgttcggatctatgttggtgattaccaccttcttgcaccacaacgatgaggagactccatggtatgctgattctgagtggacttacgtgaagggaaacttgtcctctgtggatagatcttacggtgctctcatcgataacctctcccacaacatcggaactcaccagatccaccacctcttcccaattatcccacactacaagctcaagaaggctactgctgctttccaccaagctttcccagagcttgtgagaaagtccgatgagccaatcatcaaggctttcttcagagtgggaaggttgtatgctaactacggagtggttgatcaagaggctaagctcttcactttgaaggaggctaaggctgctactgaagctgctgctaagaccaagtctacctgattaatgaatcgacaagctcgagtttctccataataatgtgtgagtagttcccagataagggaattagggttcctatagggtttcgctcatgtgttgagcatataagaaacccttagtatgtatttgtatttgtaaaatacttctatcaataaaatttctaattcctaaaaccaaaatccagtactaaaatccagatcccccgaattaattcggcgttaattcagctacgtaggctcagctgagcttacctaaggctacgtaggctcacgtgacgttacgtaaggctacgtagcgtcacgtgagcttacctaactctagctagcctcacgtgaccttagctaacactaggtagcgtcagcacagatgaatactagctgttgttcacagttctagtgtctcctcattacgtgaattcaagctacgatcactatctcaactcctacataaacatcagaatgctacaaaactatgcacaaaaacaaaagctacatctaatacgtgaatcaattactctcatcacaagaaagaagatttcaatcaccgtcgagaaggaggattcagttaattgaatcaaagttccgatcaaactcgaagactggtgagcacgaggacgacgaagaagagtgtctcgaagatacaacaagcaagaaatctactgagtgacctcctgaagttattggcgcgattgagagaatcaatccgaattaatttcggggaaaaagataaattagatactaagcgatgggcttgggctgggctaagaaacaggtggcaattgggctggaggaccccgcgattcatagcttccgatagcccaaaaaaaaacggataacatatttatcgggtatttgaatttcagtgaaataagatattttctttttgttaggaaaattttagaaaataatggaaattaaatagcgattatgttacaagatacgatcagcatcgggcagtgcaaaatgctatagcttcccaagatttgatccttttgggttatctcctaatgacaattagtttaggattttgaaacttatattaatactattatccgacaacacttgtttcagcttcttattttaacattttttgtttttttctattcttcttcccatcagcattttctttttaaaaaattgaatactttaactttttaaaaatttcacaatgatcagatgatattatggaagatctcaagagttaaatgtatccatcttggggcattaaaaccggtgtacgggatgataaatacagactttatatcatatgatagctcagtaattcatatttatcacgttgctaaaaaaattataaggtactagtagtcaacaaaatcaattaaagagaaagaaagaaacgcatgtgaagagagtttacaactggaaaagtaaaataaaaattaacgcatgttgaatgctgacatgtcagtatgtccatgaatccacgtatcaagcgccattcatcgatcgtcttcctctttctaaatgaaaacaacttcacacatcacaacaaacaatacacacaagaccccctctctctcgttgtctctctgccagcgaccaaatcgaagcttgagaagaacaagaaggggtcaaaccatgggaaaaggatctgagggaagatctgctgctagagagatgactgctgaggctaacggagataagagaaagaccatcctcattgagggagtgttgtacgatgctaccaacttcaaacacccaggaggttccattattaacttcctcaccgagggagaagctggagttgatgctacccaagcttacagagagttccatcagagatccggaaaggctgataagtacctcaagtccctcccaaagttggatgcttctaaggtggagtctaggttctctgctaaggagcaggctagaagggacgctatgaccagggattacgctgctttcagagaggagttggttgctgagggatacttcgatccatctatcccacacatgatctacagagtggtggagattgtggctttgttcgctttgtctttctggttgatgtctaaggcttctccaacctctttggttttgggagtggtgatgaacggaatcgctcaaggaagatgcggatgggttatgcacgagatgggacacggatctttcactggagttatctggctcgatgataggatgtgcgagttcttctacggagttggatgtggaatgtctggacactactggaagaaccagcactctaagcaccacgctgctccaaacagattggagcacgatgtggatttgaacaccttgccactcgttgctttcaacgagagagttgtgaggaaggttaagccaggatctttgttggctttgtggctcagagttcaggcttatttgttcgctccagtgtcttgcttgttgatcggattgggatggaccttgtacttgcacccaagatatatgctcaggaccaagagacacatggagtttgtgtggatcttcgctagatatatcggatggttctccttgatgggagctttgggatattctcctggaacttctgtgggaatgtacctctgctctttcggacttggatgcatctacatcttcctccaattcgctgtgtctcacacccacttgccagttaccaacccagaggatcaattgcactggcttgagtacgctgctgatcacaccgtgaacatctctaccaagtcttggttggttacctggtggatgtctaacctcaacttccaaatcgagcaccacttgttcccaaccgctccacaattcaggttcaaggagatctctccaagagttgaggctctcttcaagagacacaacctcccttactacgatttgccatacacctctgctgtttctactaccttcgctaacctctactctgttggacactctgttggagctgataccaagaagcaggattgatgattaatgaataattgattgtacatactatattttttgtttaccttgtgttagtttaatgttcagtgtcctctctttattgtggcacgtctctttgttgtatgttgtgtctatacaaagttgaaataatggaaagaaaaggaagagtgtaatttgttttgttttaagtgtttataaatatatatatataggtcatttagatagttctaggtttctataaaactctctctctggaagtagaatctgtttttgagaggatccagttgcctactaatctcccccaaaacccttcaagcttaaccttcctcttcacaacaacagaggaaacacatctcttgagctctgagttctcttctttgagcatgtctatcgctaaactcatctgccttatagcttccctcttctcttcatctctctctctcaccatttcgctgtaaaacttattctcctccctcagcctctctatctcttccttcagcatctcacaattcccaccataatcgactgaggatgattcaccgtcatcaacttcagactcagcgttgtagtcgtcatgagtctcacaagccttggaccaagaagactcatcatcgcaagttgatgatttatcatgatgcttctctgagccgtgtttgctacctagagtcagctgagcttagctaacgctagctagtgtcagctgacgttacgtaaggctaactagcgtcacgtgaccttacgtaacgctacgtaggctcagctgagcttagctaaccctagctagtgtcacgtgagcttacgctactatagaaaatgtgttatatcgacatgaccagacaaaggggcaacagttaacaaaacaattaattctttcatttgagattaaggaaggtaaggtactaaaaagattaaaaaaaatgagcttatctctttgtttctgtaataataatataagtgtgataaacttttaatataataattgtaattaggttttctacagatgagcaccactcagagacaagataagaagaaaacaattttgttaaacatgattatagaaacttttagttaagtcttgaagtatcaatataacaaaaaaaagtacacacgactatgacaataaacccactaccgtcaggttatcatttcgatgaaatgttttgatatcattaaatataacagtcacaaaaaatcatctaattataacaatataacttatacatatatttaactaaaaacttagagtttttgtaatgattctaattgatgattagagtttatagaaatacaattaaataaaaaatataattttaaaaaaacatagtaaagtcaatgagatcctctctgacctcagtgatcatttagtcatgtatgtacaacaatcattgttcatcacatgactgtaaaataaataaggataaacttgggaatatatataatatattgtattaaataaaaaagggaaatacaaatatcaattttagattcccgagttgacacaactcaccatgcacgctgccacctcagctcccagctctcgtcacatgtctcatgtcagttaggtctttggtttttagtctttgacacaactcgccatgcatgttgccacgtgagctcgttcctcttcccatgatctcaccactgggcatgcatgctgccacctcagctggcacctcttctctatatgtccctagaggccatgcacagtgccacctcagcactcctctcagaacccatacgtacctgccaatcggcttctctccataaatatctatttaaattataactaattatttcatatacttaattgatgacgtggatgcattgccatcgttgtttaataattgttaattacgacatgataaataaaatgaaagtaaaaagtacgaaagattttccatttgttgttgtataaatagagaagtgagtgatgcataatgcatgaatgcatgaccgcgccaccatgactgttggatacgacgaggagatcccattcgagcaagttagggctcataacaagccagacgacgcttggtgtgctattcacggacacgtgtacgacgttaccaagttcgcttcagttcacccaggaggagatattatcttgctcgctgctggaaaggaagctactgtcctctacgagacctaccatgttagaggagtgtctgacgctgtgctcagaaagtacagaataggaaagttgccagacggacaaggaggagctaacgagaaggagaagagaaccttgtctggattgtcctctgcttcttactacacctggaactccgatttctacagagtgatgagggagagagttgtggctagattgaaggagagaggaaaggctagaagaggaggatacgaactctggatcaaggctttcttgctccttgttggattctggtcctctctttactggatgtgcaccctcgatccatctttcggagctatcttggctgctatgtctttgggagtgttcgctgcttttgttggaacctgcatccaacacgatggaaaccacggagctttcgctcaatctagatgggttaacaaggtggcaggatggactttggatatgatcggagcttctggaatgacttgggagttccaacacgtgttgggacaccacccatacactaacttgatcgaggaggagaacggattgcaaaaggtgtccggaaagaagatggataccaagttggctgatcaagagtctgatccagatgtgttctccacctacccaatgatgagattgcacccttggcaccagaagaggtggtatcacaggttccagcacatctacggacctttcatcttcggattcatgaccatcaacaaggtggtgactcaagatgttggagtggtgttgagaaagagactcttccaaatcgatgctgagtgcagatatgcttccccaatgtacgttgctaggttctggattatgaaggctttgaccgtgttgtatatggttgctttgccttgttatatgcaaggaccttggcacggattgaaactcttcgctatcgctcacttcacttgcggagaggttttggctaccatgttcatcgtgaaccacattatcgagggagtgtcttacgcttctaaggatgctgttaagggaactatggctccaccaaagactatgcacggagtgaccccaatgaacaacactagaaaggaggttgaggctgaggcttctaagtctggagctgtggttaagtctgtgccattggatgattgggctgctgttcagtgccaaacctctgtgaactggtctgttggatcttggttttggaaccacttctctggaggactcaaccaccaaatcgagcaccacctcttcccaggattgtctcacgagacctactaccacatccaagacgtggttcaatctacctgtgctgagtacggagttccataccaacacgagccatctttgtggactgcttactggaagatgctcgaacaccttagacaattgggaaacgaggagactcacgagtcatggcagagagctgcttgattaatgaactaagactcccaaaaccaccttccctgtgacagttaaaccctgcttatacctttcctcctaataatgttcatctgtcacacaaactaaaataaataaaatgggagcaataaataaaatgggagctcatatatttacaccatttacactgtctattattcaccatgccaattattacttcataattttaaaattatgtcatttttaaaaattgcttaatgatggaaaggattattataagttaaaagtataacatagataaactaaccacaaaacaaatcaatataaactaacttactctcccatctaatttttatttaaatttctttacacttctcttccatttctatttctacaacattatttaacatttttattgtatttttcttactttctaactctattcatttcaaaaatcaatatatgtttatcaccacctctctaaaaaaaactttacaatcattggtccagaaaagttaaatcacgagatggtcattttagcattaaaacaacgattcttgtatcactatttttcagcatgtagtccattctcttcaaacaaagacagcggctatataatcgttgtgttatattcagtctaaaacaactagctagcctcagctgacgttacgtaacgctaggtagcgtcacgtgacgttagctaacgctaggtagcgtcagctgagcttacgtaagcgccacgggcaggacatagggactactacaagcatagtatgcttcagacaaagagctaggaaagaactcttgatggaggttaagagaaaaaagtgctagaggggcatagtaatcaaacttgtcaaaaccgtcatcatgatgagggatgacataatataaaaagttgactaaggtcttggtagtactctttgattagtattatatattggtgagaacatgagtcaagaggagacaagaaaccgaggaaccatagtttagcaacaagatggaagttgcaaagttgagctagccgctcgattagttacatctcctaagcagtactacaaggaatggtctctatactttcatgtttagcacatggtagtgcggattgacaagttagaaacagtgcttaggagacaaagagtcagtaaaggtattgaaagagtgaagttgatgctcgacaggtcaggagaagtccctccgccagatggtgactaccaaggggttggtatcagctgagacccaaataagattcttcggttgaaccagtggttcgaccgagactcttagggtgggatttcactgtaagatttgtgcattttgttgaatataaattgacaattttttttatttaattatagattatttagaatgaattacatatttagtttctaacaaggatagcaatggatgggtatgggtacaggttaaacatatctattacccacccatctagtcgtcgggttttacacgtacccacccgtttacataaaccagaccggaattttaaaccgtacccgtccgttagcgggtttcagatttacccgtttaatcgggtaaaacctgattactaaatatatattttttatttgataaacaaaacaaaaatgttaatattttcatattggatgcaattttaagaaacacatattcataaatttccatatttgtaggaaaataaaaagaaaaatatattcaagaacacaaatttcaccgacatgacttttattacagagttggaattagatctaacaattgaaaaattaaaattaagatagaatatgttgaggaacatgacatagtataatgctgggttacccgtcgggtaggtatcgaggcggatactactaaatccatcccactcgctatccgataatcactggtttcgggtatacccattcccgtcaacaggcctttttaaccggataatttcaacttatagtgaatgaattttgaataaatagttagaataccaaaatcctggattgcatttgcaatcaaattttgtgaaccgttaaattttgcatgtacttgggatagatataatagaaccgaattttcattagtttaatttataacttactttgttcaaagaaaaaaaatatctatccaatttacttataataaaaaataatctatccaagttacttattataatcaacttgtaaaaaggtaagaatacaaatgtggtagcgtacgtgtgattatatgtgacgaaatgttatatctaacaaaagtccaaattcccatggtaaaaaaaatcaaaatgcatggcaggctgtttgtaaccttggaataagatgttggccaattctggagccgccacgtacgcaagactcagggccacgttctcttcatgcaaggatagtagaacaccactccacccacctcctatattagacctttgcccaaccctccccaactttcccatcccatccacaaagaaaccgacatttttatcataaatcagggtttcgtttttgtttcatcgataaactcaaaggtgatgattttagggtcttgtgagtgtgcttttttgtttgattctactgtagggtttatgttctttagctcataggttttgtgtatttcttagaaatgtggcttctttaatctctgggtttgtgactttttgtgtggtttctgtgtttttcatatcaaaaacctattttttccgagtttttttttacaaattcttactctcaagcttgaatacttcacatgcagtgttcttttgtagattttagagttaatgtgttaaaaagtttggatttttcttgcttatagagcttcttcactttgattttgtgggtttttttgttttaaaggtgagatttttgatgaggtttttgcttcaaagatgtcacctttctgggtttgtcttttgaataaagctatgaactgtcacatggctgacgcaattttgttactatgtcatgaaagctgacgtttttccgtgttatacatgtttgcttacacttgcatgcgtcaaaaaaattggggctttttagttttagtcaaagattttacttctcttttgggatttatgaaggaaagttgcaaactttctcaaattttaccatttttgctttgatgtttgtttagattgcgacagaacaaactcatatatgttgaaatttttgcttggttttgtataggattgtgtcttttgcttataaatgttgaaatctgaactttttttttgtttggtttctttgagcaggagataaggcgcaccaccatggcttctacatctgctgctcaagacgctgctccttacgagttcccttctctcactgagatcaagagggctcttccttctgagtgtttcgaggcttctgttcctctttctctctactacaccgctagatctcttgctcttgctggatctctcgctgttgctctctcttacgctagagctttgcctcttgttcaggctaacgctcttcttgatgctactctctgcactggatacgttcttctccagggaatcgttttctggggattcttcaccgttggtcacgattgtggacacggagctttctctagatctcacgtgctcaacttctctgttggaaccctcatgcactctatcatccttacccctttcgagtcttggaagctctctcacagacaccaccacaagaacaccggaaacatcgataaggacgagatcttctaccctcaaagagaggctgattctcaccctgtttctagacaccttgtgatgtctcttggatctgcttggttcgcttaccttttcgctggattccctcctagaaccatgaaccacttcaacccttgggaggctatgtatgttagaagagtggctgctgtgatcatctctctcggagttcttttcgctttcgctggactctactcttacctcaccttcgttcttggattcaccactatggctatctactacttcggacctctcttcatcttcgctaccatgcttgttgttaccactttcctccaccacaacgatgaggagacaccttggtacgctgattctgagtggacttacgtgaagggaaacctctcttctgtggacagatcttacggtgctctcatcgacaaccttagccacaacatcggaactcaccagatccaccacctcttccctatcatccctcactacaagctcaacgatgctactgctgctttcgctaaggctttccctgagcttgttaggaaaaacgctgctcctatcatcccaactttcttcaggatggctgctatgtacgctaagtacggagttgttgacactgatgctaagaccttcactctcaaggaggctaaggctgctgctaagactaagtcatcttgatgattaatgaaggccgcagatatcagatctggtcgacctagaggatccccggccgcaaagataataacaaaagcctactatataacgtacatgcaagtattgtatgatattaatgtttttacgtacgtgtaaacaaaaataattacgtttgtaacgtatggtgatgatgtggtgcactaggtgtaggccttgtattaataaaaagaagtttgttctatatagagtggtttagtacgacgatttatttactagtcggattggaatagagaaccgaattcttcaatccttgcttttgatcaagaattgaaaccgaatcaaatgtaaaagttgatatatttgaaaaacgtattgagcttatgaaaatgctaatactctcatctgtatggaaaagtgactttaaaaccgaacttaaaagtgacaaaaggggaatatcgcatcaaaccgaatgaaaccgatctacgtaggctcagctgagcttacctaaggctacgtaggctcacgtgacgttacgtaaggctacgtagcgtcacgtgagcttacctaactctagctagcctcacgtgaccttagctaacactaggtagcgtcagcttagcagatatttggtgtctaaatgtttattttgtgatatgttcatgtttgaaatggtggtttcgaaaccagggacaacgttgggatctgatagggtgtcaaagagtattatggattgggacaatttcggtcatgagttgcaaattcaagtatatcgttcgattatgaaaattttcgaagaatatcccatttgagagagtctttacctcattaatgtttttagattatgaaattttatcatagttcatcgtagtctttttggtgtaaaggctgtaaaaagaaattgttcacttttgttttcgtttatgtgaaggctgtaaaagattgtaaaagactattttggtgttttggataaaatgatagtttttatagattcttttgcttttagaagaaatacatttgaaattttttccatgttgagtataaaataccgaaatcgattgaagatcatagaaatattttaactgaaaacaaatttataactgattcaattctctccatttttatacctatttaaccgtaatcgattctaatagatgatcgattttttatataatcctaattaaccaacggcatgtattggataattaaccgatcaactctcacccctaatagaatcagtattttccttcgacgttaattgatcctacactatgtaggtcatatccatcgttttaatttttggccaccattcaattctgtcttgcctttagggatgtgaatatgaacggccaaggtaagagaataaaaataatccaaattaaagcaagagaggccaagtaagataatccaaatgtacacttgtcattgccaaaattagtaaaatactcggcatattgtattcccacacattattaaaataccgtatatgtattggctgcatttgcatgaataatactacgtgtaagcccaaaagaacccacgtgtagcccatgcaaagttaacactcacgaccccattcctcagtctccactatataaacccaccatccccaatctcaccaaacccaccacacaactcacaactcactctcacaccttaaagaaccaatcaccaccaaaaaaagttctttgctttcgaagttgccgcaacctaaacaggtttttccttcttctttcttcttattaactacgaccttgtcctttgcctatgtaaaattactaggttttcatcagttacactgattaagttcgttatagtggaagataaaatgccctcaaagcattttgcaggatatctttgatttttcaaagatatggaactgtagagtttgatagtgttcttgaatgtggttgcatgaagtttttttggtctgcatgttattttttcctcgaaatatgttttgagtccaacaagtgattcacttgggattcagaaagttgttttctcaatatgtaacagtttttttctatggagaaaaatcatagggaccgttggttttggcttctttaattttgagctcagattaaacccattttacccggtgttcttggcagaattgaaaacagtacgtagtaccgcgcctaccatgccacctagtgctgctagtgaaggtggtgttgctgaacttagagctgctgaagttgctagctacactagaaaggctgttgacgaaagacctgacctcactatagttggtgacgctgtttacgacgctaaggcttttagggacgagcaccctggtggtgctcacttcgttagccttttcggaggtagggacgctactgaggcttttatggaatatcaccgtagagcttggcctaaggctaggatgtctaagttcttcgttggttcacttgacgctagcgagaagcctactcaagctgattcatcttaccttagactttgcgctgaggttaacgctcttttgcctaagggtagcggaggattcgctcctcctagctactggcttaaggctgctgctcttgttgttgctgctgttagtatagagggttatatgctccttaggggtaagacccttttgcttagcgttttccttggactcgtgttcgcttggataggacttaatattcagcacgacgctaatcacggtgctcttagtagacactcagtgattaactactgcctcggttacgctcaggattggataggtggtaatatggtgctttggcttcaagagcacgttgtgatgcaccacctccacactaacgacgttgacgctgatcctgatcaaaaggctcacggtgttcttagacttaagcctactgacggttggatgccttggcacgcacttcaacaactctatatccttcctggtgaggctatgtacgcttttaagcttcttttcttggacgcccttgagcttcttgcttggaggtgggagggtgagaagattagccctcttgctagagctttgttcgctcctgctgttgcttgtaagcttggattctgggctagattcgttgctctccctctctggcttcaacctactgttcacactgctttgtgtatctgtgctactgtgtgtactggtagcttctacctcgccttcttcttctttatctctcacaacttcgacggtgttggtagcgttggacctaagggatcacttcctagatcagctactttcgttcaacgtcaggttgagactagctctaacgttggtggttactggcttggagttcttaacggtggacttaactttcagatagagcaccacttgttccctaggcttcaccactcttactacgctcaaatagctcctgtggttaggactcacatagagaagctcggttttaagtaccgtcacttccctaccgttggatctaaccttagctcaatgcttcagcatatgggtaagatgggaactagacctggtgctgagaagggtggtaaggctgagtagtgattaatgaataattgattgctgctttaatgagatatgcgagacgcctatgatcgcatgatatttgctttcaattctgttgtgcacgttgtaaaaaacctgagcatgtgtagctcagatccttaccgccggtttcggttcattctaatgaatatatcacccgttactatcgtatttttatgaataatattctccgttcaatttactgattgtctacgtagcgtcacctgacgttacgtaaggctacctaggctcacgtgacgttacgtaacgctacgtagcgtcaggtgaggttagctaacgctagctagcctcacctgacgttaggtaaggctacgtagcgtcacctgagattagctaagcctacctagactcacgtgaccttaggtaacgctacgtagcgtcaaagctttacaacgctacacaaaacttataaccgtaatcaccattcattaacttaactactatcacatgcattcatgaattgaaacgagaaggatgtaaatagttgggaagttatctccacgttgaagagatcgttagcgagagctgaaagaccgagggaggagacgccgtcaacacggacagagtcgtcgaccctcacatgaagtaggaggaatctccgtgaggagccagagagacgtctttggtcttcggtttcgatccttgatctgacggagaagacgagagaagtgcgactggactccgtgaggaccaacagagtcgtcctcggtttcgatcgtcggtattggtggagaaggcggaggaatctccgtgacgagccagagagatgtcgtcggtcttcggtttcgatccttgatctgacggagaagacgagagaagtgcgacgagactccgtgaggaccaacagagttgtcctcggtttcgatcgtcggtttcggcggagaaggcggaggaatctccgtgaggagccagagagacgtcgttggtcttcggtttcgatccttgatctgttggagaagacgagacaagtgggacgagactcaacgacggagtcagagacgtcgtcggtcttcggtttcggccgagaaggcggagtcggtcttcggtttcggccgagaaggcggaggagacgtcttcgatttgggtctctcctcttgacgaagaaaacaaagaacacgagaaataatgagaaagagaacaaaagaaaaaaaaataaaaataaaaataaaatttggtcctcttatgtggtgacacgtggtttgaaacccaccaaataatcgatcacaaaaaacctaagttaaggatcggtaataacctttctaattaattttgatttatattaaatcactctttttatttataaaccccactaaattatgcgatattgattgtctaagtacaaaaattctctcgaattcaatacacatgtttcatatatttagccctgttcatttaatattactagcgcatttttaatttaaaattttgtaaacttttttggtcaaagaacatttttttaattagagacagaaatctagactctttatttggaataatagtaataaagatatattaggcaatgagtttatgatgttatgtttatatagtttatttcattttaaattgaaaagcattatttttatcgaaatgaatctagtatacaatcaatatttatgttttttcatcagatactttcctattttttggcacctttcatcggactactgatttatttcaatgtgtatgcatgcatgagcatgagtatacacatgtcttttaaaatgcatgtaaagcgtaacggaccacaaaagaggatccatacaaatacatctcatcgcttcctctactattctccgacacacacactgagcatggtgcttaaacactctggtgagttctagtacttctgctatgatcgatctcattaccatttcttaaatttctctccctaaatattccgagttcttgatttttgataacttcaggttttctctttttgataaatctggtctttccatttttttttttttgtggttaatttagtttcctatgttcttcgattgtattatgcatgatctgtgtttggattctgttagattatgtattggtgaatatgtatgtgtttttgcatgtctggttttggtcttaaaaatgttcaaatctgatgatttgattgaagcttttttagtgttggtttgattcttctcaaaactactgttaatttactatcatgttttccaactttgattcatgatgacacttttgttctgctttgttataaaattttggttggtttgattttgtaattatagtgtaattttgttaggaatgaacatgttttaatactctgttttcgatttgtcacacattcgaattattaatcgataatttaactgaaaattcatggttctagatcttgttgtcatcagattatttgtttcgataattcatcaaatatgtagtccttttgctgatttgcgactgtttcattttttctcaaaattgttttttgttaagtttatctaacagttatcgttgtcaaaagtctctttcattttgcaaaatcttctttttttttttgtttgtaactttgttttttaagctacacatttagtctgtaaaatagcatcgaggaacagttgtcttagtagacttgcatgttcttgtaacttctatttgtttcagtttgttgatgactgctttgattttgtaggtcaaaccgcgccatgtctgctagcggagctttgttgcctgctatagctttcgctgcttacgcttacgctacctacgcttatgctttcgagtggagccacgctaacggaatcgataacgtggatgctagagagtggattggagctttgtctttgagactccctgcaattgcaaccacaatgtacctcttgttctgccttgtgggacctagattgatggctaagagggaggcttttgatcctaagggatttatgctcgcttacaacgcttaccaaaccgctttcaacgttgtggtgctcggaatgttcgctagagagatctctggattgggacaacctgtttggggatctactatgccttggagcgataggaagtccttcaagattttgttgggagtgtggctccactacaacaataagtacctcgagttgttggatactgtgttcatggtggctaggaaaaagaccaagcagctctctttcttgcacgtgtaccaccacgctttgttgatttgggcttggtggcttgtttgtcacctcatggctaccaacgattgcatcgatgcttatttcggagctgcttgcaactctttcatccacatcgtgatgtactcctactacctcatgtctgctttgggaattaggtgcccttggaagagatatatcacccaggctcagatgttgcaattcgtgatcgtgttcgctcacgctgttttcgtgctcagacaaaagcactgccctgttactttgccttgggcacaaatgttcgtgatgacaaatatgttggtgctcttcggaaacttctacctcaaggcttactctaacaagtctaggggagatggagcttcttctgttaagcctgctgagactactagagcaccttctgtgagaagaaccaggtcaaggaagatcgattgatagttaatgaactaagtttgatgtatctgagtgccaacgtttactttgtctttcctttcttttattggttatgattagatgtttactatgttctctctttttcgttataaataaagaagttcaattcttctatagtttcaaacgcgattttaagcgtttctatttaggtttacatgatttcttttacaaaatcatctttaaaatacagtatatttttagttttcataaaatatttaaagaaatgaaagtttataaacattcactcctattctctaattaaggatttgtaaaacaaaaattttgtaagcatatcgatttatgcgttttgtcttaattagctcactaaataataaataatagcttatgttgtgggactgtttaattacctaacttagaactaaaatcaactctttgtgctagctagcctcagctgacgttacgtaacgctaggtagcgtcacgtgacgttagctaacgctaggtagcgtcagctgagcttacgtaagcgcttaattaaagtactgatatcggtaccaaatcgaatccaaaaattacggatatgaatataggcatatccgtatccgaattatccgtttgacagctagcaacgattgtacaattgcttctttaaaaaaggaagaaagaaagaaagaaaagaatcaacatcagcgttaacaaacggccccgttacggcccaaacggtcatatagagtaacggcgttaagcgttgaaagactcctatcgaaatacgtaaccgcaaacgtgtcatagtcagatcccctcttccttcaccgcctcaaacacaaaaataatcttctacagcctatatatacaacccccccttctatctctcctttctcacaattcatcatctttctttctctacccccaattttaagaaatcctctcttctcctcttcattttcaaggtaaatctctctctctctctctctctctgttattccttgttttaattaggtatgtattattgctagtttgttaatctgcttatcttatgtatgccttatgtgaatatctttatcttgttcatctcatccgtttagaagctataaatttgttgatttgactgtgtatctacacgtggttatgtttatatctaatcagatatgaatttcttcatattgttgcgtttgtgtgtaccaatccgaaatcgttgatttttttcatttaatcgtgtagctaattgtacgtatacatatggatctacgtatcaattgttcatctgtttgtgtttgtatgtatacagatctgaaaacatcacttctctcatctgattgtgttgttacatacatagatatagatctgttatatcattttttttattaattgtgtatatatatatgtgcatagatctggattacatgattgtgattatttacatgattttgttatttacgtatgtatatatgtagatctggactttttggagttgttgacttgattgtatttgtgtgtgtatatgtgtgttctgatcttgatatgttatgtatgtgcagctgaaccatggcggcggcaacaacaacaacaacaacatcttcttcgatctccttctccaccaaaccatctccttcctcctccaaatcaccattaccaatctccagattctccctcccattctccctaaaccccaacaaatcatcctcctcctcccgccgccgcggtatcaaatccagctctccctcctccatctccgccgtgctcaacacaaccaccaatgtcacaaccactccctctccaaccaaacctaccaaacccgaaacattcatctcccgattcgctccagatcaaccccgcaaaggcgctgatatcctcgtcgaggctttagaacgtcaaggcgtagaaaccgtattcgcttaccctggaggtacatcaatggagattcaccaagccttaacccgctcttcctcaatccgtaacgtccttcctcgtcacgaacaaggaggtgtattcgcagcagaaggatacgctcgatcctcaggtaaaccaggtatctgtatagccacttcaggtcccggagctacaaatctcgttagcggattagccgatgcgttgttagatagtgttcctcttgtagcaatcacaggacaagtccctcgtcgtatgattggtacagatgcgtttcaagagactccgattgttgaggtaacgcgttcgattacgaagcataactatcttgtgatggatgttgaagatatcccaaggattattgaagaggctttctttttagctacttctggtagacctggacctgttttggttgatgttcctaaagatattcaacaacagcttgcgattcctaattgggaacaggctatgagattacctggttatatgtctaggatgcctaaacctccggaagattctcatttggagcagattgttaggttgatttctgagtctaagaagcctgtgttgtatgttggtggtggttgtcttaattctagcgatgaattgggtaggtttgttgagcttacgggcatccctgttgcgagtacgttgatggggctgggatcttatccttgtgatgatgagttgtcgttacatatgcttggaatgcatgggactgtgtatgcaaattacgctgtggagcatagtgatttgttgttggcgtttggggtaaggtttgatgatcgtgtcacgggtaaacttgaggcttttgctagtagggctaagattgttcatattgatattgactcggctgagattgggaagaataagactcctcatgtgtctgtgtgtggtgatgttaagctggctttgcaagggatgaataaggttcttgagaaccgagcggaggagcttaaacttgattttggagtttggaggaatgagttgaacgtacagaaacagaagtttccgttgagctttaagacgtttggggaagctattcctccacagtatgcgattaaggtccttgatgagttgactgatggaaaagccataataagtactggtgtcgggcaacatcaaatgtgggcggcgcagttctacaattacaagaaaccaaggcagtggctatcatcaggaggccttggagctatgggatttggacttcctgctgcgattggagcgtctgttgctaaccctgatgcgatagttgtggatattgacggagatggaagttttataatgaatgtgcaagagctagccactattcgtgtagagaatcttccagtgaaggtacttttattaaacaaccagcatcttggcatggttatgcaatgggaagatcggttctacaaagctaaccgagctcacacatttctcggggacccggctcaggaggacgagatattcccgaacatgttgctgtttgcagcagcttgcgggattccagcggcgagggtgacaaagaaagcagatctccgagaagctattcagacaatgctggatacaccaggaccttacctgttggatgtgatttgtccgcaccaagaacatgtgttgccgatgatcccgaatggtggcactttcaacgatgtcataacggaaggagatggccggattaaatactgagagatgaaaccggtgattatcagaaccttttatggtctttgtatgcatatggtaaaaaaacttagtttgcaatttcctgtttgttttggtaatttgagtttcttttagttgttgatctgcctgctttttggtttacgtcagactactactgctgttgttgtttggtttcctttctttcattttataaataaataatccggttcggtttactccttgtgactggctcagtttggttattgcgaaatgcgaatggtaaattgagtaattgaaattcgttattagggttctaagctgttttaacagtcactgggttaatatctctcgaatcttgcatggaaaatgctcttaccattggtttttaattgaaatgtgctcatatgggccgtggtttccaaattaaataaaactacgatgtcatcgagaagtaaaatcaactgtgtccacattatcagttttgtgtatacgatgaaatagggtaattcaaaatctagcttgatatgccttttggttcattttaaccttctgtaaacattttttcagattttgaacaagtaaatccaaaaaaaaaaaaaaaaatctcaactcaacactaaattattttaatgtataaaagatgcttaaaacatttggcttaaaagaaagaagctaaaaacatagagaactcttgtaaattgaagtatgaaaatatactgaattgggtattatatgaatttttctgatttaggattcacatgatccaaaaaggaaatccagaagcactaatcagacattggaagtaggattaatcagtgatcagtaactattaaattcaattaaccgcggacatctacatttttgaattgaaaaaaaattggtaattactctttctttttctccatattgaccatcatactcattgctgatccatgtagatttcccggacatgaagccatttacaattgaatatatcct

SEQ ID NO: 291 - DNA, 20 bp, Artificial sequence
  LBFLFK Locus 2 RB junction region
tatatttaaaccagtcagca

SEQ ID NO: 292 - DNA, 20 bp, Artificial sequence
  LBFLFK Locus 2 LB junction region
aatatatcctcacatatgaa

SEQ ID NO: 293 - DNA, 2900 bp, Artificial sequence; identical to SEQ ID NO: 230
  LBFLFK Locus 2 flanking sequence up to and including the right border of the T-DNA

SEQ ID NO: 294 - DNA, 1800 bp, Artificial sequence; identical to SEQ ID NO: 231
  LBFLFK Locus 2 flanking sequence up to and including the left border of the T-DNA

SEQ ID NO: 295 - DNA, 25 bp, Artificial sequence
  LBFLFK Locus 2_Forward primer
ccatattgaccatcatactcattgc

SEQ ID NO: 296 - DNA, 26 bp, Artificial sequence
  LBFLFK Locus 2_Reverse primer
tggctgatagggttctttcaaatata

SEQ ID NO: 297 - DNA, 25 bp, Artificial sequence
  LBFLFK locus 2_Probe
taaattatacttgatcggtcatctg

SEQ ID NO: 298 - DNA, 45777 bp, Artificial sequence
  contig of insert and flanking sequences of LBFDAU T-DNA locus 1
aaaagaaatataaaagaatatgaccaaaaaagtaaacgtgagtgagagaataagaaaatgactacaaaatataatagcctcaattatcttcaaaactaagttgacatttaattatgcttttgcaagatatttacttttgttgttcgatcatatttaatgattattttggttttgaaacaaatattaacattatatatattgtgtctatattgaactgttgtaaattataaacatcaaaattttaatgttatcttaattataatttctaatactagtatattcaaaaatcaaaataaacatattttataaaatagtgccagtacgtagtatgggagataatactagtggctttataaagggaaacattgtctctaaaatctcagataaaatgttaaaacacacttattcacaattatgaagatttgaaatatctgaaatttcaaattgatgcacttggtagaaagcaaaggttcaacgctaagtctacaaggtgtaataatgaagtgaaaatgctagtttagattacccttgatatgtgactgaacatagggtggagcgtcagtgagtccatggagtacagaagctaaacaagagacatggttaagcaccagaatcaactcgttctccatagagtccagcttttgagatatatgtgaatagccttgttgcaatatacttgtgagtggcaggcgtgatcttattaacgaaagtccaaattctgaacaaagtttatatcaagctacgatggaaatatggaatccgtatcaaaatcaactgtactgtatcatacggtgcagatttttagctcgactctaccaccttgcgtttacttttgtgatgaacattgcgattatatatgaggacctaaatagagggaaaatgtatgaagacaggatcctaagaatgaaaaaccagcatccccaagatgtggcaccaagtgctatcgaccacaaactacgctggacatactctgatatagttcgttaagaaatcaaaatgtcaacacatataaataagcagtcagcatcatcacaccaaaagttaggcccgaatagtttgaaattagaaagctcgcaattgaggtctacaggccaaattcgctcttagccgtacaatattactcaccggtgcgatgccccccatcgtaggtgaaggtggaaattaatggcgcgcctgatcactgattagtaactattacgtaagcctacgtagcgtcacgtgacgttagctaacgctacgtagcctcagctgacgttacgtaagcctacgtagcgtcacgtgagcttagctaacgctacctaggctcagctgacgttacgtaacgctagctagcgtcactcctgcagcaaatttacacattgccactaaacgtctaaacccttgtaatttgtttttgttttactatgtgtgttatgtatttgatttgcgataaatttttatatttggtactaaatttataacaccttttatgctaacgtttgccaacacttagcaatttgcaagttgattaattgattctaaattatttttgtcttctaaatacatatactaatcaactggaaatgtaaatatttgctaatatttctactataggagaattaaagtgagtgaatatggtaccacaaggtttggagatttaattgttgcaatgctgcatggatggcatatacaccaaacattcaataattcttgaggataataatggtaccacacaagatttgaggtgcatgaacgtcacgtggacaaaaggtttagtaatttttcaagacaacaatgttaccacacacaagttttgaggtgcatgcatggatgccctgtggaaagtttaaaaatattttggaaatgatttgcatggaagccatgtgtaaaaccatgacatccacttggaggatgcaataatgaagaaaactacaaatttacatgcaactagttatgcatgtagtctatataatgaggattttgcaatactttcattcatacacactcactaagttttacacgattataatttcttcatagccagtactgtttaagcttcactgtctctgaatcggcaaaggtaaacgtatcaattattctacaaacccttttatttttcttttgaattaccgtcttcattggttatatgataacttgataagtaaagcttcaataattgaatttgatctgtgtttttttggccttaatactaaatccttacataagctttgttgcttctcctcttgtgagttgagtgttaagttgtaataatggttcactttcagctttagaagaaaccatggaagttgttgagaggttctacggagagttggatggaaaggtttcccaaggagtgaacgctttgttgggatctttcggagttgagttgactgataccccaactactaagggattgccactcgttgattctccaactccaattgtgttgggagtgtctgtttacttgaccatcgtgatcggaggattgctttggatcaaggctagagatctcaagccaagagcttctgagccattcttgttgcaagctttggtgttggtgcacaacttgttctgcttcgctttgtctctttacatgtgcgtgggtatcgcttaccaagctatcacctggagatattccttgtggggaaacgcttataacccaaagcacaaggagatggctatcctcgtttacctcttctacatgtccaagtacgtggagttcatggataccgtgatcatgatcctcaagagatccaccagacagatttctttcctccacgtgtaccaccactcttctatctcccttatctggtgggctattgctcaccacgctccaggaggagaggcttattggagtgctgctctcaactctggagtgcacgtgttgatgtacgcttactacttcttggctgcttgcttgagatcttccccaaagctcaagaacaagtacctcttctggggaagatacctcacccaattccagatgttccagttcatgctcaacttggtgcaagcttactacgatatgaaaaccaacgctccatatccacaatggctcatcaagatcctcttctactacatgatctccctcttgttcctcttcggaaacttctacgtgcaaaagtacatcaagccatccgatggaaagcaaaagggagctaagaccgagtgatcgacaagctcgagtttctccataataatgtgtgagtagttcccagataagggaattagggttcctatagggtttcgctcatgtgttgagcatataagaaacccttagtatgtatttgtatttgtaaaatacttctatcaataaaatttctaattcctaaaaccaaaatccagtactaaaatccagatcccccgaattaattcggcgttaattcagctagctagcctcagctgacgttacgtaacgctaggtagcgtcacgtgacgttagctaacgctaggtagcgtcagctgagcttacgtaagcgcttagcagatatttggtgtctaaatgtttattttgtgatatgttcatgtttgaaatggtggtttcgaaaccagggacaacgttgggatctgatagggtgtcaaagagtattatggattgggacaatttcggtcatgagttgcaaattcaagtatatcgttcgattatgaaaattttcgaagaatatcccatttgagagagtctttacctcattaatgtttttagattatgaaattttatcatagttcatcgtagtctttttggtgtaaaggctgtaaaaagaaattgttcacttttgttttcgtttatgtgaaggctgtaaaagattgtaaaagactattttggtgttttggataaaatgatagtttttatagattcttttgcttttagaagaaatacatttgaaattttttccatgttgagtataaaataccgaaatcgattgaagatcatagaaatattttaactgaaaacaaatttataactgattcaattctctccatttttatacctatttaaccgtaatcgattctaatagatgatcgattttttatataatcctaattaaccaacggcatgtattggataattaaccgatcaactctcacccctaatagaatcagtattttccttcgacgttaattgatcctacactatgtaggtcatatccatcgttttaatttttggccaccattcaattctgtcttgcctttagggatgtgaatatgaacggccaaggtaagagaataaaaataatccaaattaaagcaagagaggccaagtaagataatccaaatgtacacttgtcattgccaaaattagtaaaatactcggcatattgtattcccacacattattaaaataccgtatatgtattggctgcatttgcatgaataatactacgtgtaagcccaaaagaacccacgtgtagcccatgcaaagttaacactcacgaccccattcctcagtctccactatataaacccaccatccccaatctcaccaaacccaccacacaactcacaactcactctcacaccttaaagaaccaatcaccaccaaaaaatttcacgatttggaatttgattcctgcgatcacaggtatgacaggttagattttgttttgtatagttgtatacatacttctttgtgatgttttgtttacttaatcgaatttttggagtgttttaaggtctctcgtttagaaatcgtggaaaatatcactgtgtgtgtgttcttatgattcacagtgtttatgggtttcatgttctttgttttatcattgaatgggaagaaatttcgttgggatacaaatttctcatgttcttactgatcgttattaggagtttggggaaaaaggaagagtttttttggttggttcgagtgattatgaggttatttctgtatttgatttatgagttaatggtcgttttaatgttgtagaccatgggaaaaggatctgagggaagatctgctgctagagagatgactgctgaggctaacggagataagagaaagaccatcctcattgagggagtgttgtacgatgctaccaacttcaaacacccaggaggttccattattaacttcctcaccgagggagaagctggagttgatgctacccaagcttacagagagttccatcagagatccggaaaggctgataagtacctcaagtccctcccaaagttggatgcttctaaggtggagtctaggttctctgctaaggagcaggctagaagggacgctatgaccagggattacgctgctttcagagaggagttggttgctgagggatacttcgatccatctatcccacacatgatctacagagtggtggagattgtggctttgttcgctttgtctttctggttgatgtctaaggcttctccaacctctttggttttgggagtggtgatgaacggaatcgctcaaggaagatgcggatgggttatgcacgagatgggacacggatctttcactggagttatctggctcgatgataggatgtgcgagttcttctacggagttggatgtggaatgtctggacactactggaagaaccagcactctaagcaccacgctgctccaaacagattggagcacgatgtggatttgaacaccttgccactcgttgctttcaacgagagagttgtgaggaaggttaagccaggatctttgttggctttgtggctcagagttcaggcttatttgttcgctccagtgtcttgcttgttgatcggattgggatggaccttgtacttgcacccaagatatatgctcaggaccaagagacacatggagtttgtgtggatcttcgctagatatatcggatggttctccttgatgggagctttgggatattctcctggaacttctgtgggaatgtacctctgctctttcggacttggatgcatctacatcttcctccaattcgctgtgtctcacacccacttgccagttaccaacccagaggatcaattgcactggcttgagtacgctgctgatcacaccgtgaacatctctaccaagtcttggttggttacctggtggatgtctaacctcaacttccaaatcgagcaccacttgttcccaaccgctccacaattcaggttcaaggagatctctccaagagttgaggctctcttcaagagacacaacctcccttactacgatttgccatacacctctgctgtttctactaccttcgctaacctctactctgttggacactctgttggagctgataccaagaagcaggattgactgctttaatgagatatgcgagacgcctatgatcgcatgatatttgctttcaattctgttgtgcacgttgtaaaaaacctgagcatgtgtagctcagatccttaccgccggtttcggttcattctaatgaatatatcacccgttactatcgtatttttatgaataatattctccgttcaatttactgattgtctacgtaggctcagctgagcttacctaaggctacgtaggctcacgtgacgttacgtaaggctacgtagcgtcacgtgagcttacctaactctagctagcctcacgtgaccttagctaacactaggtagcgtcagctcgacggcccggactgtatccaacttctgatctttgaatctctctgttccaacatgttctgaaggagttctaagacttttcagaaagcttgtaacatgctttgtagactttctttgaattactcttgcaaactctgattgaacctacgtgaaaactgctccagaagttctaaccaaattccgtcttgggaaggcccaaaatttattgagtacttcagtttcatggacgtgtcttcaaagatttataacttgaaatcccatcatttttaagagaagttctgttccgcaatgtcttagatctcattgaaatctacaactcttgtgtcagaagttcttccagaatcaacttgcatcatggtgaaaatctggccagaagttctgaacttgtcatatttcttaacagttagaaaaatttctaagtgtttagaattttgacttttccaaagcaaacttgacttttgactttcttaataaaacaaacttcatattctaacatgtcttgatgaaatgtgattcttgaaatttgatgttgatgcaaaagtcaaagtttgacttttcagtgtgcaattgaccattttgctcttgtgccaattccaaacctaaattgatgtatcagtgctgcaaacttgatgtcatggaagatcttatgagaaaattcttgaagactgagaggaaaaattttgtagtacaacacaaagaatcctgtttttcatagtcggactagacacattaacataaaacaccacttcattcgaagagtgattgaagaaggaaatgtgcagttacctttctgcagttcataagagcaacttacagacacttttactaaaatactacaaagaggaagattttaacaacttagagaagtaatgggagttaaagagcaacacattaagggggagtgttaaaattaatgtgttgtaaccaccactacctttagtaagtattataagaaaattgtaatcatcacattataattattgtccttatttaaaattatgataaagttgtatcattaagattgagaaaaccaaatagtcctcgtcttgatttttgaattattgttttctatgttacttttcttcaagcctatataaaaactttgtaatgctaaattgtatgctggaaaaaaatgtgtaatgaattgaatagaaattatggtatttcaaagtccaaaatccatcaatagaaatttagtacaaaacgtaactcaaaaatattctcttattttaaattttacaacaatataaaaatattctcttattttaaattttacaataatataatttatcacctgtcacctttagaataccaccaacaatattaatacttagatattttattcttaataattttgagatctctcaatatatctgatatttattttatatttgtgtcatattttcttatgttttagagttaacccttatatcttggtcaaactagtaattcaatatatgagtttgtgaaggacacattgacatcttgaaacattggttttaaccttgttggaatgttaaaggtaataaaacattcagaattatgaccatctattaatatacttcctttgtcttttaaaaaagtgtgcatgaaaatgctctatggtaagctagagtgtcttgctggcctgtgtatatcaattccatttccagatggtagaaactgccactacgaataattagtcataagacacgtatgttaacacacgtccccttgcatgttttttgccatatattccgtctctttctttttcttcacgtataaaacaatgaactaattaatagagcgatcaagctgaacagttctttgctttcgaagttgccgcaacctaaacaggtttttccttcttctttcttcttattaactacgaccttgtcctttgcctatgtaaaattactaggttttcatcagttacactgattaagttcgttatagtggaagataaaatgccctcaaagcattttgcaggatatctttgatttttcaaagatatggaactgtagagtttgatagtgttcttgaatgtggttgcatgaagtttttttggtctgcatgttattttttcctcgaaatatgttttgagtccaacaagtgattcacttgggattcagaaagttgttttctcaatatgtaacagtttttttctatggagaaaaatcatagggaccgttggttttggcttctttaattttgagctcagattaaacccattttacccggtgttcttggcagaattgaaaacagtacgtagtaccgcgcctaccatgtgtgttgagaccgagaacaacgatggaatccctactgtggagatcgctttcgatggagagagagaaagagctgaggctaacgtgaagttgtctgctgagaagatggaacctgctgctttggctaagaccttcgctagaagatacgtggttatcgagggagttgagtacgatgtgaccgatttcaaacatcctggaggaaccgtgattttctacgctctctctaacactggagctgatgctactgaggctttcaaggagttccaccacagatctagaaaggctaggaaggctttggctgctttgccttctagacctgctaagaccgctaaagtggatgatgctgagatgctccaggatttcgctaagtggagaaaggagttggagagggacggattcttcaagccttctcctgctcatgttgcttacagattcgctgagttggctgctatgtacgctttgggaacctacttgatgtacgctagatacgttgtgtcctctgtgttggtttacgcttgcttcttcggagctagatgtggatgggttcaacacgagggaggacactcttctttgaccggaaacatctggtgggataagagaatccaagctttcactgctggattcggattggctggatctggagatatgtggaactccatgcacaacaagcaccacgctactcctcaaaaagtgaggcacgatatggatttggataccactcctgctgttgctttcttcaacaccgctgtggaggataatagacctaggggattctctaagtactggctcagattgcaagcttggaccttcattcctgtgacttctggattggtgttgctcttctggatgttcttcctccacccttctaaggctttgaagggaggaaagtacgaggagcttgtgtggatgttggctgctcacgtgattagaacctggaccattaaggctgttactggattcaccgctatgcaatcctacggactcttcttggctacttcttgggtttccggatgctacttgttcgctcacttctctacttctcacacccacttggatgttgttcctgctgatgagcacttgtcttgggttaggtacgctgtggatcacaccattgatatcgatccttctcagggatgggttaactggttgatgggatacttgaactgccaagtgattcaccacctcttcccttctatgcctcaattcagacaacctgaggtgtccagaagattcgttgctttcgctaagaagtggaacctcaactacaaggtgatgacttatgctggagcttggaaggctactttgggaaacctcgataatgtgggaaagcactactacgtgcacggacaacactctggaaagaccgcttgattaatgaaggccgcctcgaccgtaccccctgcagatagactatactatgttttagcctgcctgctggctagctactatgttatgttatgttgtaaaataaacacctgctaaggtatatctatctatattttagcatggctttctcaataaattgtctttccttatcgtttactatcttatacctaataatgaaataataatatcacatatgaggaacggggcaggtttaggcatatatatacgagtgtagggcggagtggggctacgtagcgtcacgtgacgttacctaagcctaggtagcctcagctgacgttacgtaacgctaggtaggctcagctgacacgggcaggacatagggactactacaagcatagtatgcttcagacaaagagctaggaaagaactcttgatggaggttaagagaaaaaagtgctagaggggcatagtaatcaaacttgtcaaaaccgtcatcatgatgagggatgacataatataaaaagttgactaaggtcttggtagtactctttgattagtattatatattggtgagaacatgagtcaagaggagacaagaaaccgaggaaccatagtttagcaacaagatggaagttgcaaagttgagctagccgctcgattagttacatctcctaagcagtactacaaggaatggtctctatactttcatgtttagcacatggtagtgcggattgacaagttagaaacagtgcttaggagacaaagagtcagtaaaggtattgaaagagtgaagttgatgctcgacaggtcaggagaagtccctccgccagatggtgactaccaaggggttggtatcagctgagacccaaataagattcttcggttgaaccagtggttcgaccgagactcttagggtgggatttcactgtaagatttgtgcattttgttgaatataaattgacaattttttttatttaattatagattatttagaatgaattacatatttagtttctaacaaggatagcaatggatgggtatgggtacaggttaaacatatctattacccacccatctagtcgtcgggttttacacgtacccacccgtttacataaaccagaccggaattttaaaccgtacccgtccgttagcgggtttcagatttacccgtttaatcgggtaaaacctgattactaaatatatattttttatttgataaacaaaacaaaaatgttaatattttcatattggatgcaattttaagaaacacatattcataaatttccatatttgtaggaaaataaaaagaaaaatatattcaagaacacaaatttcaccgacatgacttttattacagagttggaattagatctaacaattgaaaaattaaaattaagatagaatatgttgaggaacatgacatagtataatgctgggttacccgtcgggtaggtatcgaggcggatactactaaatccatcccactcgctatccgataatcactggtttcgggtatacccattcccgtcaacaggcctttttaaccggataatttcaacttatagtgaatgaattttgaataaatagttagaataccaaaatcctggattgcatttgcaatcaaattttgtgaaccgttaaattttgcatgtacttgggatagatataatagaaccgaattttcattagtttaatttataacttactttgttcaaagaaaaaaaatatctatccaatttacttataataaaaaataatctatccaagttacttattataatcaacttgtaaaaaggtaagaatacaaatgtggtagcgtacgtgtgattatatgtgacgaaatgttatatctaacaaaagtccaaattcccatggtaaaaaaaatcaaaatgcatggcaggctgtttgtaaccttggaataagatgttggccaattctggagccgccacgtacgcaagactcagggccacgttctcttcatgcaaggatagtagaacaccactccacccacctcctatattagacctttgcccaaccctccccaactttcccatcccatccacaaagaaaccgacatttttatcataaatctggtgcttaaacactctggtgagttctagtacttctgctatgatcgatctcattaccatttcttaaatttctctccctaaatattccgagttcttgatttttgataacttcaggttttctctttttgataaatctggtctttccattttttttttttgtggttaatttagtttcctatgttcttcgattgtattatgcatgatctgtgtttggattctgttagattatgtattggtgaatatgtatgtgtttttgcatgtctggttttggtcttaaaaatgttcaaatctgatgatttgattgaagcttttttagtgttggtttgattcttctcaaaactactgttaatttactatcatgttttccaactttgattcatgatgacacttttgttctgctttgttataaaattttggttggtttgattttgtaattatagtgtaattttgttaggaatgaacatgttttaatactctgttttcgatttgtcacacattcgaattattaatcgataatttaactgaaaattcatggttctagatcttgttgtcatcagattatttgtttcgataattcatcaaatatgtagtccttttgctgatttgcgactgtttcattttttctcaaaattgttttttgttaagtttatctaacagttatcgttgtcaaaagtctctttcattttgcaaaatcttctttttttttttgtttgtaactttgttttttaagctacacatttagtctgtaaaatagcatcgaggaacagttgtcttagtagacttgcatgttcttgtaacttctatttgtttcagtttgttgatgactgctttgattttgtaggtcaaaggcgcaccctaccatggatgcttataacgctgctatggataagattggagctgctatcatcgattggagtgatccagatggaaagttcagagctgatagggaggattggtggttgtgcgatttcagatccgctatcaccattgctctcatctacatcgctttcgtgatcttgggatctgctgtgatgcaatctctcccagctatggacccataccctatcaagttcctctacaacgtgtctcaaatcttcctctgcgcttacatgactgttgaggctggattcctcgcttataggaacggatacaccgttatgccatgcaaccacttcaacgtgaacgatccaccagttgctaacttgctctggctcttctacatctccaaagtgtgggatttctgggataccatcttcattgtgctcggaaagaagtggagacaactctctttcttgcacgtgtaccaccacaccaccatcttcctcttctactggttgaacgctaacgtgctctacgatggagatatcttcttgaccatcctcctcaacggattcattcacaccgtgatgtacacctactacttcatctgcatgcacaccaaggattctaagaccggaaagtctttgccaatctggtggaagtcatctttgaccgctttccaactcttgcaattcaccatcatgatgtcccaagctacctacttggttttccacggatgcgataaggtttccctcagaatcaccatcgtgtacttcgtgtacattctctcccttttcttcctcttcgctcagttcttcgtgcaatcctacatggctccaaagaagaagaagtccgcttgatgttaatgaaggccgcagatatcagatctggtcgacctagaggatccccggccgcaaagataataacaaaagcctactatataacgtacatgcaagtattgtatgatattaatgtttttacgtacgtgtaaacaaaaataattacgtttgtaacgtatggtgatgatgtggtgcactaggtgtaggccttgtattaataaaaagaagtttgttctatatagagtggtttagtacgacgatttatttactagtcggattggaatagagaaccgaattcttcaatccttgcttttgatcaagaattgaaaccgaatcaaatgtaaaagttgatatatttgaaaaacgtattgagcttatgaaaatgctaatactctcatctgtatggaaaagtgactttaaaaccgaacttaaaagtgacaaaaggggaatatcgcatcaaaccgaatgaaaccgatctacgtaggctcagctgagcttagctaagcctacctagcctcacgtgagattatgtaaggctaggtagcgtcacgtgacgttacctaacactagctagcgtcagctgagcttagctaaccctacgtagcctcacgtgagcttacctaacgctacgtagcctcacgtgactaaggatgacctacccattcttgagacaaatgttacattttagtatcagagtaaaatgtgtacctataactcaaattcgattgacatgtatccattcaacataaaattaaaccagcctgcacctgcatccacatttcaagtattttcaaaccgttcggctcctatccaccgggtgtaacaagacggattccgaatttggaagattttgactcaaattcccaatttatattgaccgtgactaaatcaactttaacttctataattctgattaagctcccaatttatattcccaacggcactacctccaaaatttatagactctcatccccttttaaaccaacttagtaaacgttttttttttaattttatgaagttaagtttttaccttgtttttaaaaagaatcgttcataagatgccatgccagaacattagctacacgttacacatagcatgcagccgcggagaattgtttttcttcgccacttgtcactcccttcaaacacctaagagcttctctctcacagcacacacatacaatcacatgcgtgcatgcattattacacgtgatcgccatgcaaatctcctttatagcctataaattaactcatcggcttcactctttactcaaaccaaaactcatcaatacaaacaagattaaaaacatttcacgatttggaatttgattcctgcgatcacaggtatgacaggttagattttgttttgtatagttgtatacatacttctttgtgatgttttgtttacttaatcgaatttttggagtgttttaaggtctctcgtttagaaatcgtggaaaatatcactgtgtgtgtgttcttatgattcacagtgtttatgggtttcatgttctttgttttatcattgaatgggaagaaatttcgttgggatacaaatttctcatgttcttactgatcgttattaggagtttggggaaaaaggaagagtttttttggttggttcgagtgattatgaggttatttctgtatttgatttatgagttaatggtcgttttaatgttgtagaccgccatggctattttgaaccctgaggctgattctgctgctaacctcgctactgattctgaggctaagcaaagacaattggctgaggctggatacactcacgttgagggtgctcctgctcctttgcctttggagttgcctcacttctctctcagagatctcagagctgctattcctaagcactgcttcgagagatctttcgtgacctccacctactacatgatcaagaacgtgttgacttgcgctgctttgttctacgctgctaccttcattgatagagctggagctgctgcttatgttttgtggcctgtgtactggttcttccagggatcttacttgactggagtgtgggttatcgctcacgagtgtggacaccaggcttattgctcttctgaggtggtgaacaacttgattggactcgtgttgcactctgctttgttggtgccttaccactcttggagaatctctcacagaaagcaccactccaacactggatcttgcgagaacgatgaggttttcgttcctgtgaccagatctgtgttggcttcttcttggaacgagaccttggaggattctcctctctaccaactctaccgtatcgtgtacatgttggttgttggatggatgcctggatacctcttcttcaacgctactggacctactaagtactggggaaagtctaggtctcacttcaacccttactccgctatctatgctgatagggagaggtggatgatcgtgctctccgatattttcttggtggctatgttggctgttttggctgctttggtgcacactttctccttcaacacgatggtgaagttctacgtggtgccttacttcattgtgaacgcttacttggtgttgattacctacctccaacacaccgatacctacatccctcacttcagagagggagagtggaattggttgagaggagctttgtgcactgtggatagatcatttggtccattcctcgattctgtggtgcatagaatcgtggatacccacgtttgccaccatatcttctccaagatgcctttctatcactgcgaggaggctaccaacgctattaagcctctcctcggaaagttctacttgaaggatactactcctgttcctgttgctctctggagatcttacacccactgcaagttcgttgaggatgatggaaaggtggtgttctacaagaacaagttatagttaatgaataattgattggttcgagtattatggcattgggaaaactgtttttcttgtaccatttgttgtgcttgtaatttactgtgttttttattcggttttcgctatcgaactgtgaaatggaaatggatggagaagagttaatgaatgatatggtccttttgttcattctcaaattaatattatttgttttttctcttatttgttgtgtgttgaatttgaaattataagagatatgcaaacattttgttttgagtaaaaatgtgtcaaatcgtggcctctaatgaccgaagttaatatgaggagtaaaacacttgtagttgtaccattatgcttattcactaggcaacaaatatattttcagacctagaaaagctgcaaatgttactgaatacaagtatgtcctcttgtgttttagacatttatgaactttcctttatgtaattttccagaatccttgtcagattctaatcattgctttataattatagttatactcatggatttgtagttgagtatgaaaatattttttaatgcattttatgacttgccaattgattgacaacatgcatcaatctagctagcctcagctgacgttacgtaacgctaggtagcgtcacgtgacgttagctaacgctaggtagcgtcagctgagcttacgtaagcgcacagatgaatactagctgttgttcacagttctagtgtctcctcattacgtgaattcaagctacgatcactatctcaactcctacataaacatcagaatgctacaaaactatgcacaaaaacaaaagctacatctaatacgtgaatcaattactctcatcacaagaaagaagatttcaatcaccgtcgagaaggaggattcagttaattgaatcaaagttccgatcaaactcgaagactggtgagcacgaggacgacgaagaagagtgtctcgaagatacaacaagcaagaaatctactgagtgacctcctgaagttattggcgcgattgagagaatcaatccgaattaatttcggggaaaaagataaattagatactaagcgatgggcttgggctgggctaagaaacaggtggcaattgggctggaggaccccgcgattcatagcttccgatagcccaaaaaaaaacggataacatatttatcgggtatttgaatttcagtgaaataagatattttctttttgttaggaaaattttagaaaataatggaaattaaatagcgattatgttacaagatacgatcagcatcgggcagtgcaaaatgctatagcttcccaagatttgatccttttgggttatctcctaatgacaattagtttaggattttgaaacttatattaatactattatccgacaacacttgtttcagcttcttattttaacattttttgtttttttctattcttcttcccatcagcattttctttttaaaaaattgaatactttaactttttaaaaatttcacaatgatcagatgatattatggaagatctcaagagttaaatgtatccatcttggggcattaaaaccggtgtacgggatgataaatacagactttatatcatatgatagctcagtaattcatatttatcacgttgctaaaaaaattataaggtactagtagtcaacaaaatcaattaaagagaaagaaagaaacgcatgtgaagagagtttacaactggaaaagtaaaataaaaattaacgcatgttgaatgctgacatgtcagtatgtccatgaatccacgtatcaagcgccattcatcgatcgtcttcctctttctaaatgaaaacaacttcacacatcacaacaaacaatacacacaagaccccctctctctcgttgtctctctgccagcgaccaaatcgaagcttgagaagaacaagaaggggtcaaaccatggcttctacatctgctgctcaagacgctgctccttacgagttcccttctctcactgagatcaagagggctcttccttctgagtgtttcgaggcttctgttcctctttctctctactacaccgctagatctcttgctcttgctggatctctcgctgttgctctctcttacgctagagctttgcctcttgttcaggctaacgctcttcttgatgctactctctgcactggatacgttcttctccagggaatcgttttctggggattcttcaccgttggtcacgattgtggacacggagctttctctagatctcacgtgctcaacttctctgttggaaccctcatgcactctatcatccttacccctttcgagtcttggaagctctctcacagacaccaccacaagaacaccggaaacatcgataaggacgagatcttctaccctcaaagagaggctgattctcaccctgtttctagacaccttgtgatgtctcttggatctgcttggttcgcttaccttttcgctggattccctcctagaaccatgaaccacttcaacccttgggaggctatgtatgttagaagagtggctgctgtgatcatctctctcggagttcttttcgctttcgctggactctactcttacctcaccttcgttcttggattcaccactatggctatctactacttcggacctctcttcatcttcgctaccatgcttgttgttaccactttcctccaccacaacgatgaggagacaccttggtacgctgattctgagtggacttacgtgaagggaaacctctcttctgtggacagatcttacggtgctctcatcgacaaccttagccacaacatcggaactcaccagatccaccacctcttccctatcatccctcactacaagctcaacgatgctactgctgctttcgctaaggctttccctgagcttgttaggaaaaacgctgctcctatcatcccaactttcttcaggatggctgctatgtacgctaagtacggagttgttgacactgatgctaagaccttcactctcaaggaggctaaggctgctgctaagactaagtcatcttgatgattaatgaataattgattgtacatactatattttttgtttaccttgtgttagtttaatgttcagtgtcctctctttattgtggcacgtctctttgttgtatgttgtgtctatacaaagttgaaataatggaaagaaaaggaagagtgtaatttgttttgttttaagtgtttataaatatatatatataggtcatttagatagttctaggtttctataaaactctctctctggaagtagaatctgtttttgagaggatccagttgcctactaatctcccccaaaacccttcaagcttaaccttcctcttcacaacaacagaggaaacacatctcttgagctctgagttctcttctttgagcatgtctatcgctaaactcatctgccttatagcttccctcttctcttcatctctctctctcaccatttcgctgtaaaacttattctcctccctcagcctctctatctcttccttcagcatctcacaattcccaccataatcgactgaggatgattcaccgtcatcaacttcagactcagcgttgtagtcgtcatgagtctcacaagccttggaccaagaagactcatcatcgcaagttgatgatttatcatgatgcttctctgagccgtgtttgctacgtagcgtcacgtgacgttacctaagcctaggtagcctcagctgacgttacgtaacgctaggtaggctcagctgactgcagcaaatttacacattgccactaaacgtctaaacccttgtaatttgtttttgttttactatgtgtgttatgtatttgatttgcgataaatttttatatttggtactaaatttataacaccttttatgctaacgtttgccaacacttagcaatttgcaagttgattaattgattctaaattatttttgtcttctaaatacatatactaatcaactggaaatgtaaatatttgctaatatttctactataggagaattaaagtgagtgaatatggtaccacaaggtttggagatttaattgttgcaatgctgcatggatggcatatacaccaaacattcaataattcttgaggataataatggtaccacacaagatttgaggtgcatgaacgtcacgtggacaaaaggtttagtaatttttcaagacaacaatgttaccacacacaagttttgaggtgcatgcatggatgccctgtggaaagtttaaaaatattttggaaatgatttgcatggaagccatgtgtaaaaccatgacatccacttggaggatgcaataatgaagaaaactacaaatttacatgcaactagttatgcatgtagtctatataatgaggattttgcaatactttcattcatacacactcactaagttttacacgattataatttcttcatagccagtactgtttaagcttcactgtctctgaatcggcaaaggtaaacgtatcaattattctacaaacccttttatttttcttttgaattaccgtcttcattggttatatgataacttgataagtaaagcttcaataattgaatttgatctgtgtttttttggccttaatactaaatccttacataagctttgttgcttctcctcttgtgagttgagtgttaagttgtaataatggttcactttcagctttagaagaaacgcgccttccatggctacaaaggaggcttacgttttcccaactctcaccgagatcaagagatctctcccaaaggattgcttcgaggcttctgtgcctttgtctctctactacactgtgagatgcttggttattgctgtggctttgaccttcggattgaactacgctagagctttgccagaggttgagtctttctgggctttggatgctgctttgtgcactggatatatcctcctccagggaattgtgttctggggattcttcactgttggacacgatgctggacacggagctttctctagataccacctcttgaacttcgttgtgggaaccttcatgcactctctcatcttgaccccattcgagtcttggaagttgacccacagacaccaccacaagaacaccggaaacatcgatagagatgaggtgttctacccacagagaaaggctgatgatcacccattgtccaggaacttgatcttggctttgggagctgcttggcttgcttatttggtggagggattcccaccaagaaaggtgaaccacttcaacccattcgagccactttttgtgagacaagtgtccgctgtggttatctctttgctcgctcacttcttcgttgctggactctctatctacttgtctctccagttgggacttaagaccatggctatctactactacggaccagttttcgtgttcggatctatgttggtgattaccaccttcttgcaccacaacgatgaggagactccatggtatgctgattctgagtggacttacgtgaagggaaacttgtcctctgtggatagatcttacggtgctctcatcgataacctctcccacaacatcggaactcaccagatccaccacctcttcccaattatcccacactacaagctcaagaaggctactgctgctttccaccaagctttcccagagcttgtgagaaagtccgatgagccaatcatcaaggctttcttcagagtgggaaggttgtatgctaactacggagtggttgatcaagaggctaagctcttcactttgaaggaggctaaggctgctactgaagctgctgctaagaccaagtctacctgattaatgaatcgacaagctcgagtttctccataataatgtgtgagtagttcccagataagggaattagggttcctatagggtttcgctcatgtgttgagcatataagaaacccttagtatgtatttgtatttgtaaaatacttctatcaataaaatttctaattcctaaaaccaaaatccagtactaaaatccagatcccccgaattaattcggcgttaattcagctacgtaggctcagctgagcttacctaaggctacgtaggctcacgtgacgttacgtaaggctacgtagcgtcacgtgagcttacctaactctagctagcctcacgtgaccttagctaacactaggtagcgtcagcacagatgaatactagctgttgttcacagttctagtgtctcctcattacgtgaattcaagctacgatcactatctcaactcctacataaacatcagaatgctacaaaactatgcacaaaaacaaaagctacatctaatacgtgaatcaattactctcatcacaagaaagaagatttcaatcaccgtcgagaaggaggattcagttaattgaatcaaagttccgatcaaactcgaagactggtgagcacgaggacgacgaagaagagtgtctcgaagatacaacaagcaagaaatctactgagtgacctcctgaagttattggcgcgattgagagaatcaatccgaattaatttcggggaaaaagataaattagatactaagcgatgggcttgggctgggctaagaaacaggtggcaattgggctggaggaccccgcgattcatagcttccgatagcccaaaaaaaaacggataacatatttatcgggtatttgaatttcagtgaaataagatattttctttttgttaggaaaattttagaaaataatggaaattaaatagcgattatgttacaagatacgatcagcatcgggcagtgcaaaatgctatagcttcccaagatttgatccttttgggttatctcctaatgacaattagtttaggattttgaaacttatattaatactattatccgacaacacttgtttcagcttcttattttaacattttttgtttttttctattcttcttcccatcagcattttctttttaaaaaattgaatactttaactttttaaaaatttcacaatgatcagatgatattatggaagatctcaagagttaaatgtatccatcttggggcattaaaaccggtgtacgggatgataaatacagactttatatcatatgatagctcagtaattcatatttatcacgttgctaaaaaaattataaggtactagtagtcaacaaaatcaattaaagagaaagaaagaaacgcatgtgaagagagtttacaactggaaaagtaaaataaaaattaacgcatgttgaatgctgacatgtcagtatgtccatgaatccacgtatcaagcgccattcatcgatcgtcttcctctttctaaatgaaaacaacttcacacatcacaacaaacaatacacacaagaccccctctctctcgttgtctctctgccagcgaccaaatcgaagcttgagaagaacaagaaggggtcaaaccatgggaaaaggatctgagggaagatctgctgctagagagatgactgctgaggctaacggagataagagaaagaccatcctcattgagggagtgttgtacgatgctaccaacttcaaacacccaggaggttccattattaacttcctcaccgagggagaagctggagttgatgctacccaagcttacagagagttccatcagagatccggaaaggctgataagtacctcaagtccctcccaaagttggatgcttctaaggtggagtctaggttctctgctaaggagcaggctagaagggacgctatgaccagggattacgctgctttcagagaggagttggttgctgagggatacttcgatccatctatcccacacatgatctacagagtggtggagattgtggctttgttcgctttgtctttctggttgatgtctaaggcttctccaacctctttggttttgggagtggtgatgaacggaatcgctcaaggaagatgcggatgggttatgcacgagatgggacacggatctttcactggagttatctggctcgatgataggatgtgcgagttcttctacggagttggatgtggaatgtctggacactactggaagaaccagcactctaagcaccacgctgctccaaacagattggagcacgatgtggatttgaacaccttgccactcgttgctttcaacgagagagttgtgaggaaggttaagccaggatctttgttggctttgtggctcagagttcaggcttatttgttcgctccagtgtcttgcttgttgatcggattgggatggaccttgtacttgcacccaagatatatgctcaggaccaagagacacatggagtttgtgtggatcttcgctagatatatcggatggttctccttgatgggagctttgggatattctcctggaacttctgtgggaatgtacctctgctctttcggacttggatgcatctacatcttcctccaattcgctgtgtctcacacccacttgccagttaccaacccagaggatcaattgcactggcttgagtacgctgctgatcacaccgtgaacatctctaccaagtcttggttggttacctggtggatgtctaacctcaacttccaaatcgagcaccacttgttcccaaccgctccacaattcaggttcaaggagatctctccaagagttgaggctctcttcaagagacacaacctcccttactacgatttgccatacacctctgctgtttctactaccttcgctaacctctactctgttggacactctgttggagctgataccaagaagcaggattgatgattaatgaataattgattgtacatactatattttttgtttaccttgtgttagtttaatgttcagtgtcctctctttattgtggcacgtctctttgttgtatgttgtgtctatacaaagttgaaataatggaaagaaaaggaagagtgtaatttgttttgttttaagtgtttataaatatatatatataggtcatttagatagttctaggtttctataaaactctctctctggaagtagaatctgtttttgagaggatccagttgcctactaatctcccccaaaacccttcaagcttaaccttcctcttcacaacaacagaggaaacacatctcttgagctctgagttctcttctttgagcatgtctatcgctaaactcatctgccttatagcttccctcttctcttcatctctctctctcaccatttcgctgtaaaacttattctcctccctcagcctctctatctcttccttcagcatctcacaattcccaccataatcgactgaggatgattcaccgtcatcaacttcagactcagcgttgtagtcgtcatgagtctcacaagccttggaccaagaagactcatcatcgcaagttgatgatttatcatgatgcttctctgagccgtgtttgctacctagagtcagctgagcttagctaacgctagctagtgtcagctgacgttacgtaaggctaactagcgtcacgtgaccttacgtaacgctacgtaggctcagctgagcttagctaaccctagctagtgtcacgtgagcttacgctactatagaaaatgtgttatatcgacatgaccagacaaaggggcaacagttaacaaaacaattaattctttcatttgagattaaggaaggtaaggtactaaaaagattaaaaaaaatgagcttatctctttgtttctgtaataataatataagtgtgataaacttttaatataataattgtaattaggttttctacagatgagcaccactcagagacaagataagaagaaaacaattttgttaaacatgattatagaaacttttagttaagtcttgaagtatcaatataacaaaaaaaagtacacacgactatgacaataaacccactaccgtcaggttatcatttcgatgaaatgttttgatatcattaaatataacagtcacaaaaaatcatctaattataacaatataacttatacatatatttaactaaaaacttagagtttttgtaatgattctaattgatgattagagtttatagaaatacaattaaataaaaaatataattttaaaaaaacatagtaaagtcaatgagatcctctctgacctcagtgatcatttagtcatgtatgtacaacaatcattgttcatcacatgactgtaaaataaataaggataaacttgggaatatatataatatattgtattaaataaaaaagggaaatacaaatatcaattttagattcccgagttgacacaactcaccatgcacgctgccacctcagctcccagctctcgtcacatgtctcatgtcagttaggtctttggtttttagtctttgacacaactcgccatgcatgttgccacgtgagctcgttcctcttcccatgatctcaccactgggcatgcatgctgccacctcagctggcacctcttctctatatgtccctagaggccatgcacagtgccacctcagcactcctctcagaacccatacgtacctgccaatcggcttctctccataaatatctatttaaattataactaattatttcatatacttaattgatgacgtggatgcattgccatcgttgtttaataattgttaattacgacatgataaataaaatgaaagtaaaaagtacgaaagattttccatttgttgttgtataaatagagaagtgagtgatgcataatgcatgaatgcatgaccgcgccaccatgactgttggatacgacgaggagatcccattcgagcaagttagggctcataacaagccagacgacgcttggtgtgctattcacggacacgtgtacgacgttaccaagttcgcttcagttcacccaggaggagatattatcttgctcgctgctggaaaggaagctactgtcctctacgagacctaccatgttagaggagtgtctgacgctgtgctcagaaagtacagaataggaaagttgccagacggacaaggaggagctaacgagaaggagaagagaaccttgtctggattgtcctctgcttcttactacacctggaactccgatttctacagagtgatgagggagagagttgtggctagattgaaggagagaggaaaggctagaagaggaggatacgaactctggatcaaggctttcttgctccttgttggattctggtcctctctttactggatgtgcaccctcgatccatctttcggagctatcttggctgctatgtctttgggagtgttcgctgcttttgttggaacctgcatccaacacgatggaaaccacggagctttcgctcaatctagatgggttaacaaggtggcaggatggactttggatatgatcggagcttctggaatgacttgggagttccaacacgtgttgggacaccacccatacactaacttgatcgaggaggagaacggattgcaaaaggtgtccggaaagaagatggataccaagttggctgatcaagagtctgatccagatgtgttctccacctacccaatgatgagattgcacccttggcaccagaagaggtggtatcacaggttccagcacatctacggacctttcatcttcggattcatgaccatcaacaaggtggtgactcaagatgttggagtggtgttgagaaagagactcttccaaatcgatgctgagtgcagatatgcttccccaatgtacgttgctaggttctggattatgaaggctttgaccgtgttgtatatggttgctttgccttgttatatgcaaggaccttggcacggattgaaactcttcgctatcgctcacttcacttgcggagaggttttggctaccatgttcatcgtgaaccacattatcgagggagtgtcttacgcttctaaggatgctgttaagggaactatggctccaccaaagactatgcacggagtgaccccaatgaacaacactagaaaggaggttgaggctgaggcttctaagtctggagctgtggttaagtctgtgccattggatgattgggctgctgttcagtgccaaacctctgtgaactggtctgttggatcttggttttggaaccacttctctggaggactcaaccaccaaatcgagcaccacctcttcccaggattgtctcacgagacctactaccacatccaagacgtggttcaatctacctgtgctgagtacggagttccataccaacacgagccatctttgtggactgcttactggaagatgctcgaacaccttagacaattgggaaacgaggagactcacgagtcatggcagagagctgcttgattaatgaactaagactcccaaaaccaccttccctgtgacagttaaaccctgcttatacctttcctcctaataatgttcatctgtcacacaaactaaaataaataaaatgggagcaataaataaaatgggagctcatatatttacaccatttacactgtctattattcaccatgccaattattacttcataattttaaaattatgtcatttttaaaaattgcttaatgatggaaaggattattataagttaaaagtataacatagataaactaaccacaaaacaaatcaatataaactaacttactctcccatctaatttttatttaaatttctttacacttctcttccatttctatttctacaacattatttaacatttttattgtatttttcttactttctaactctattcatttcaaaaatcaatatatgtttatcaccacctctctaaaaaaaactttacaatcattggtccagaaaagttaaatcacgagatggtcattttagcattaaaacaacgattcttgtatcactatttttcagcatgtagtccattctcttcaaacaaagacagcggctatataatcgttgtgttatattcagtctaaaacaactagctagcctcagctgacgttacgtaacgctaggtagcgtcacgtgacgttagctaacgctaggtagcgtcagctgagcttacgtaagcgccacgggcaggacatagggactactacaagcatagtatgcttcagacaaagagctaggaaagaactcttgatggaggttaagagaaaaaagtgctagaggggcatagtaatcaaacttgtcaaaaccgtcatcatgatgagggatgacataatataaaaagttgactaaggtcttggtagtactctttgattagtattatatattggtgagaacatgagtcaagaggagacaagaaaccgaggaaccatagtttagcaacaagatggaagttgcaaagttgagctagccgctcgattagttacatctcctaagcagtactacaaggaatggtctctatactttcatgtttagcacatggtagtgcggattgacaagttagaaacagtgcttaggagacaaagagtcagtaaaggtattgaaagagtgaagttgatgctcgacaggtcaggagaagtccctccgccagatggtgactaccaaggggttggtatcagctgagacccaaataagattcttcggttgaaccagtggttcgaccgagactcttagggtgggatttcactgtaagatttgtgcattttgttgaatataaattgacaattttttttatttaattatagattatttagaatgaattacatatttagtttctaacaaggatagcaatggatgggtatgggtacaggttaaacatatctattacccacccatctagtcgtcgggttttacacgtacccacccgtttacataaaccagaccggaattttaaaccgtacccgtccgttagcgggtttcagatttacccgtttaatcgggtaaaacctgattactaaatatatattttttatttgataaacaaaacaaaaatgttaatattttcatattggatgcaattttaagaaacacatattcataaatttccatatttgtaggaaaataaaaagaaaaatatattcaagaacacaaatttcaccgacatgacttttattacagagttggaattagatctaacaattgaaaaattaaaattaagatagaatatgttgaggaacatgacatagtataatgctgggttacccgtcgggtaggtatcgaggcggatactactaaatccatcccactcgctatccgataatcactggtttcgggtatacccattcccgtcaacaggcctttttaaccggataatttcaacttatagtgaatgaattttgaataaatagttagaataccaaaatcctggattgcatttgcaatcaaattttgtgaaccgttaaattttgcatgtacttgggatagatataatagaaccgaattttcattagtttaatttataacttactttgttcaaagaaaaaaaatatctatccaatttacttataataaaaaataatctatccaagttacttattataatcaacttgtaaaaaggtaagaatacaaatgtggtagcgtacgtgtgattatatgtgacgaaatgttatatctaacaaaagtccaaattcccatggtaaaaaaaatcaaaatgcatggcaggctgtttgtaaccttggaataagatgttggccaattctggagccgccacgtacgcaagactcagggccacgttctcttcatgcaaggatagtagaacaccactccacccacctcctatattagacctttgcccaaccctccccaactttcccatcccatccacaaagaaaccgacatttttatcataaatcagggtttcgtttttgtttcatcgataaactcaaaggtgatgattttagggtcttgtgagtgtgcttttttgtttgattctactgtagggtttatgttctttagctcataggttttgtgtatttcttagaaatgtggcttctttaatctctgggtttgtgactttttgtgtggtttctgtgtttttcatatcaaaaacctattttttccgagtttttttttacaaattcttactctcaagcttgaatacttcacatgcagtgttcttttgtagattttagagttaatgtgttaaaaagtttggatttttcttgcttatagagcttcttcactttgattttgtgggtttttttgttttaaaggtgagatttttgatgaggtttttgcttcaaagatgtcacctttctgggtttgtcttttgaataaagctatgaactgtcacatggctgacgcaattttgttactatgtcatgaaagctgacgtttttccgtgttatacatgtttgcttacacttgcatgcgtcaaaaaaattggggctttttagttttagtcaaagattttacttctcttttgggatttatgaaggaaagttgcaaactttctcaaattttaccatttttgctttgatgtttgtttagattgcgacagaacaaactcatatatgttgaaatttttgcttggttttgtataggattgtgtcttttgcttataaatgttgaaatctgaactttttttttgtttggtttctttgagcaggagataaggcgcaccaccatggcttctacatctgctgctcaagacgctgctccttacgagttcccttctctcactgagatcaagagggctcttccttctgagtgtttcgaggcttctgttcctctttctctctactacaccgctagatctcttgctcttgctggatctctcgctgttgctctctcttacgctagagctttgcctcttgttcaggctaacgctcttcttgatgctactctctgcactggatacgttcttctccagggaatcgttttctggggattcttcaccgttggtcacgattgtggacacggagctttctctagatctcacgtgctcaacttctctgttggaaccctcatgcactctatcatccttacccctttcgagtcttggaagctctctcacagacaccaccacaagaacaccggaaacatcgataaggacgagatcttctaccctcaaagagaggctgattctcaccctgtttctagacaccttgtgatgtctcttggatctgcttggttcgcttaccttttcgctggattccctcctagaaccatgaaccacttcaacccttgggaggctatgtatgttagaagagtggctgctgtgatcatctctctcggagttcttttcgctttcgctggactctactcttacctcaccttcgttcttggattcaccactatggctatctactacttcggacctctcttcatcttcgctaccatgcttgttgttaccactttcctccaccacaacgatgaggagacaccttggtacgctgattctgagtggacttacgtgaagggaaacctctcttctgtggacagatcttacggtgctctcatcgacaaccttagccacaacatcggaactcaccagatccaccacctcttccctatcatccctcactacaagctcaacgatgctactgctgctttcgctaaggctttccctgagcttgttaggaaaaacgctgctcctatcatcccaactttcttcaggatggctgctatgtacgctaagtacggagttgttgacactgatgctaagaccttcactctcaaggaggctaaggctgctgctaagactaagtcatcttgatgattaatgaaggccgcagatatcagatctggtcgacctagaggatccccggccgcaaagataataacaaaagcctactatataacgtacatgcaagtattgtatgatattaatgtttttacgtacgtgtaaacaaaaataattacgtttgtaacgtatggtgatgatgtggtgcactaggtgtaggccttgtattaataaaaagaagtttgttctatatagagtggtttagtacgacgatttatttactagtcggattggaatagagaaccgaattcttcaatccttgcttttgatcaagaattgaaaccgaatcaaatgtaaaagttgatatatttgaaaaacgtattgagcttatgaaaatgctaatactctcatctgtatggaaaagtgactttaaaaccgaacttaaaagtgacaaaaggggaatatcgcatcaaaccgaatgaaaccgatctacgtaggctcagctgagcttacctaaggctacgtaggctcacgtgacgttacgtaaggctacgtagcgtcacgtgagcttacctaactctagctagcctcacgtgaccttagctaacactaggtagcgtcagcttagcagatatttggtgtctaaatgtttattttgtgatatgttcatgtttgaaatggtggtttcgaaaccagggacaacgttgggatctgatagggtgtcaaagagtattatggattgggacaatttcggtcatgagttgcaaattcaagtatatcgttcgattatgaaaattttcgaagaatatcccatttgagagagtctttacctcattaatgtttttagattatgaaattttatcatagttcatcgtagtctttttggtgtaaaggctgtaaaaagaaattgttcacttttgttttcgtttatgtgaaggctgtaaaagattgtaaaagactattttggtgttttggataaaatgatagtttttatagattcttttgcttttagaagaaatacatttgaaattttttccatgttgagtataaaataccgaaatcgattgaagatcatagaaatattttaactgaaaacaaatttataactgattcaattctctccatttttatacctatttaaccgtaatcgattctaatagatgatcgattttttatataatcctaattaaccaacggcatgtattggataattaaccgatcaactctcacccctaatagaatcagtattttccttcgacgttaattgatcctacactatgtaggtcatatccatcgttttaatttttggccaccattcaattctgtcttgcctttagggatgtgaatatgaacggccaaggtaagagaataaaaataatccaaattaaagcaagagaggccaagtaagataatccaaatgtacacttgtcattgccaaaattagtaaaatactcggcatattgtattcccacacattattaaaataccgtatatgtattggctgcatttgcatgaataatactacgtgtaagcccaaaagaacccacgtgtagcccatgcaaagttaacactcacgaccccattcctcagtctccactatataaacccaccatccccaatctcaccaaacccaccacacaactcacaactcactctcacaccttaaagaaccaatcaccaccaaaaaaagttctttgctttcgaagttgccgcaacctaaacaggtttttccttcttctttcttcttattaactacgaccttgtcctttgcctatgtaaaattactaggttttcatcagttacactgattaagttcgttatagtggaagataaaatgccctcaaagcattttgcaggatatctttgatttttcaaagatatggaactgtagagtttgatagtgttcttgaatgtggttgcatgaagtttttttggtctgcatgttattttttcctcgaaatatgttttgagtccaacaagtgattcacttgggattcagaaagttgttttctcaatatgtaacagtttttttctatggagaaaaatcatagggaccgttggttttggcttctttaattttgagctcagattaaacccattttacccggtgttcttggcagaattgaaaacagtacgtagtaccgcgcctaccatgccacctagtgctgctagtgaaggtggtgttgctgaacttagagctgctgaagttgctagctacactagaaaggctgttgacgaaagacctgacctcactatagttggtgacgctgtttacgacgctaaggcttttagggacgagcaccctggtggtgctcacttcgttagccttttcggaggtagggacgctactgaggcttttatggaatatcaccgtagagcttggcctaaggctaggatgtctaagttcttcgttggttcacttgacgctagcgagaagcctactcaagctgattcagcttaccttagactttgcgctgaggttaacgctcttttgcctaagggtagcggaggattcgctcctcctagctactggcttaaggctgctgctcttgttgttgctgctgttagtatagagggttatatgctccttaggggtaagacccttttgcttagcgttttccttggactcgtgttcgcttggataggacttaatattcagcacgacgctaatcacggtgctcttagtagacactcagtgattaactactgcctcggttacgctcaggattggataggtggtaatatggtgctttggcttcaagagcacgttgtgatgcaccacctccacactaacgacgttgacgctgatcctgatcaaaaggctcacggtgttcttagacttaagcctactgacggttggatgccttggcacgcacttcaacaactctatatccttcctggtgaggctatgtacgcttttaagcttcttttcttggacgcccttgagcttcttgcttggaggtgggagggtgagaagattagccctcttgctagagctttgttcgctcctgctgttgcttgtaagcttggattctgggctagattcgttgctctccctctctggcttcaacctactgttcacactgctttgtgtatctgtgctactgtgtgtactggtagcttctacctcgccttcttcttctttatctctcacaacttcgacggtgttggtagcgttggacctaagggatcacttcctagatcagctactttcgttcaacgtcaggttgagactagctctaacgttggtggttactggcttggagttcttaacggtggacttaactttcagatagagcaccacttgttccctaggcttcaccactcttactacgctcaaatagctcctgtggttaggactcacatagagaagctcggttttaagtaccgtcacttccctaccgttggatctaaccttagctcaatgcttcagcatatgggtaagatgggaactagacctggtgctgagaagggtggtaaggctgagtagtgattaatgaataattgattgctgctttaatgagatatgcgagacgcctatgatcgcatgatatttgctttcaattctgttgtgcacgttgtaaaaaacctgagcatgtgtagctcagatccttaccgccggtttcggttcattctaatgaatatatcacccgttactatcgtatttttatgaataatattctccgttcaatttactgattgtctacgtagcgtcacctgacgttacgtaaggctacctaggctcacgtgacgttacgtaacgctacgtagcgtcaggtgaggttagctaacgctagctagcctcacctgacgttaggtaaggctacgtagcgtcacctgagattagctaagcctacctagactcacgtgaccttaggtaacgctacgtagcgtcaaagctttacaacgctacacaaaacttataaccgtaatcaccattcattaacttaactactatcacatgcattcatgaattgaaacgagaaggatgtaaatagttgggaagttatctccacgttgaagagatcgttagcgagagctgaaagaccgagggaggagacgccgtcaacacggacagagtcgtcgaccctcacatgaagtaggaggaatctccgtgaggagccagagagacgtctttggtcttcggtttcgatccttgatctgacggagaagacgagagaagtgcgactggactccgtgaggaccaacagagtcgtcctcggtttcgatcgtcggtattggtggagaaggcggaggaatctccgtgacgagccagagagatgtcgtcggtcttcggtttcgatccttgatctgacggagaagacgagagaagtgcgacgagactccgtgaggaccaacagagttgtcctcggtttcgatcgtcggtttcggcggagaaggcggaggaatctccgtgaggagccagagagacgtcgttggtcttcggtttcgatccttgatctgttggagaagacgagacaagtgggacgagactcaacgacggagtcagagacgtcgtcggtcttcggtttcggccgagaaggcggagtcggtcttcggtttcggccgagaaggcggaggagacgtcttcgatttgggtctctcctcttgacgaagaaaacaaagaacacgagaaataatgagaaagagaacaaaagaaaaaaaaataaaaataaaaataaaatttggtcctcttatgtggtgacacgtggtttgaaacccaccaaataatcgatcacaaaaaacctaagttaaggatcggtaataacctttctaattaattttgatttatattaaatcactctttttatttataaaccccactaaattatgcgatattgattgtctaagtacaaaaattctctcgaattcaatacacatgtttcatatatttagccctgttcatttaatattactagcgcatttttaatttaaaattttgtaaacttttttggtcaaagaacatttttttaattagagacagaaatctagactctttatttggaataatagtaataaagatatattaggcaatgagtttatgatgttatgtttatatagtttatttcattttaaattgaaaagcattatttttatcgaaatgaatctagtatacaatcaatatttatgttttttcatcagatactttcctattttttggcacctttcatcggactactgatttatttcaatgtgtatgcatgcatgagcatgagtatacacatgtcttttaaaatgcatgtaaagcgtaacggaccacaaaagaggatccatacaaatacatctcatcgcttcctctactattctccgacacacacactgagcatggtgcttaaacactctggtgagttctagtacttctgctatgatcgatctcattaccatttcttaaatttctctccctaaatattccgagttcttgatttttgataacttcaggttttctctttttgataaatctggtctttccatttttttttttttgtggttaatttagtttcctatgttcttcgattgtattatgcatgatctgtgtttggattctgttagattatgtattggtgaatatgtatgtgtttttgcatgtctggttttggtcttaaaaatgttcaaatctgatgatttgattgaagcttttttagtgttggtttgattcttctcaaaactactgttaatttactatcatgttttccaactttgattcatgatgacacttttgttctgctttgttataaaattttggttggtttgattttgtaattatagtgtaattttgttaggaatgaacatgttttaatactctgttttcgatttgtcacacattcgaattattaatcgataatttaactgaaaattcatggttctagatcttgttgtcatcagattatttgtttcgataattcatcaaatatgtagtccttttgctgatttgcgactgtttcattttttctcaaaattgttttttgttaagtttatctaacagttatcgttgtcaaaagtctctttcattttgcaaaatcttctttttttttttgtttgtaactttgttttttaagctacacatttagtctgtaaaatagcatcgaggaacagttgtcttagtagacttgcatgttcttgtaacttctatttgtttcagtttgttgatgactgctttgattttgtaggtcaaaccgcgccatgtctgctagcggagctttgttgcctgctatagctttcgctgcttacgcttacgctacctacgcttatgctttcgagtggagccacgctaacggaatcgataacgtggatgctagagagtggattggagctttgtctttgagactccctgcaattgcaaccacaatgtacctcttgttctgccttgtgggacctagattgatggctaagagggaggcttttgatcctaagggatttatgctcgcttacaacgcttaccaaaccgctttcaacgttgtggtgctcggaatgttcgctagagagatctctggattgggacaacctgtttggggatctactatgccttggagcgataggaagtccttcaagattttgttgggagtgtggctccactacaacaataagtacctcgagttgttggatactgtgttcatggtggctaggaaaaagaccaagcagctctctttcttgcacgtgtaccaccacgctttgttgatttgggcttggtggcttgtttgtcacctcatggctaccaacgattgcatcgatgcttatttcggagctgcttgcaactctttcatccacatcgtgatgtactcctactacctcatgtctgctttgggaattaggtgcccttggaagagatatatcacccaggctcagatgttgcaattcgtgatcgtgttcgctcacgctgttttcgtgctcagacaaaagcactgccctgttactttgccttgggcacaaatgttcgtgatgacaaatatgttggtgctcttcggaaacttctacctcaaggcttactctaacaagtctaggggagatggagcttcttctgttaagcctgctgagactactagagcaccttctgtgagaagaaccaggtcaaggaagatcgattgatagttaatgaactaagtttgatgtatctgagtgccaacgtttactttgtctttcctttcttttattggttatgattagatgtttactatgttctctctttttcgttataaataaagaagttcaattcttctatagtttcaaacgcgattttaagcgtttctatttaggtttacatgatttcttttacaaaatcatctttaaaatacagtatatttttagttttcataaaatatttaaagaaatgaaagtttataaacattcactcctattctctaattaaggatttgtaaaacaaaaattttgtaagcatatcgatttatgcgttttgtcttaattagctcactaaataataaataatagcttatgttgtgggactgtttaattacctaacttagaactaaaatcaactctttgtgctagctagcctcagctgacgttacgtaacgctaggtagcgtcacgtgacgttagctaacgctaggtagcgtcagctgagcttacgtaagcgcttaattaaagtactgatatcggtaccaaatcgaatccaaaaattacggatatgaatataggcatatccgtatccgaattatccgtttgacagctagcaacgattgtacaattgcttctttaaaaaaggaagaaagaaagaaagaaaagaatcaacatcagcgttaacaaacggccccgttacggcccaaacggtcatatagagtaacggcgttaagcgttgaaagactcctatcgaaatacgtaaccgcaaacgtgtcatagtcagatcccctcttccttcaccgcctcaaacacaaaaataatcttctacagcctatatatacaacccccccttctatctctcctttctcacaattcatcatctttctttctctacccccaattttaagaaatcctctcttctcctcttcattttcaaggtaaatctctctctctctctctctctctgttattccttgttttaattaggtatgtattattgctagtttgttaatctgcttatcttatgtatgccttatgtgaatatctttatcttgttcatctcatccgtttagaagctataaatttgttgatttgactgtgtatctacacgtggttatgtttatatctaatcagatatgaatttcttcatattgttgcgtttgtgtgtaccaatccgaaatcgttgatttttttcatttaatcgtgtagctaattgtacgtatacatatggatctacgtatcaattgttcatctgtttgtgtttgtatgtatacagatctgaaaacatcacttctctcatctgattgtgttgttacatacatagatatagatctgttatatcattttttttattaattgtgtatatatatatgtgcatagatctggattacatgattgtgattatttacatgattttgttatttacgtatgtatatatgtagatctggactttttggagttgttgacttgattgtatttgtgtgtgtatatgtgtgttctgatcttgatatgttatgtatgtgcagctgaaccatggcggcggcaacaacaacaacaacaacatcttcttcgatctccttctccaccaaaccatctccttcctcctccaaatcaccattaccaatctccagattctccctcccattctccctaaaccccaacaaatcatcctcctcctcccgccgccgcggtatcaaatccagctctccctcctccatctccgccgtgctcaacacaaccaccaatgtcacaaccactccctctccaaccaaacctaccaaacccgaaacattcatctcccgattcgctccagatcaaccccgcaaaggcgctgatatcctcgtcgaggctttagaacgtcaaggcgtagaaaccgtattcgcttaccctggaggtacatcaatggagattcaccaagccttaacccgctcttcctcaatccgtaacgtccttcctcgtcacgaacaaggaggtgtattcgcagcagaaggatacgctcgatcctcaggtaaaccaggtatctgtatagccacttcaggtcccggagctacaaatctcgttagcggattagccgatgcgttgttagatagtgttcctcttgtagcaatcacaggacaagtccctcgtcgtatgattggtacagatgcgtttcaagagactccgattgttgaggtaacgcgttcgattacgaagcataactatcttgtgatggatgttgaagatatcccaaggattattgaagaggctttctttttagctacttctggtagacctggacctgttttggttgatgttcctaaagatattcaacaacagcttgcgattcctaattgggaacaggctatgagattacctggttatatgtctaggatgcctaaacctccggaagattctcatttggagcagattgttaggttgatttctgagtctaagaagcctgtgttgtatgttggtggtggttgtcttaattctagcgatgaattgggtaggtttgttgagcttacgggcatccctgttgcgagtacgttgatggggctgggatcttatccttgtgatgatgagttgtcgttacatatgcttggaatgcatgggactgtgtatgcaaattacgctgtggagcatagtgatttgttgttggcgtttggggtaaggtttgatgatcgtgtcacgggtaaacttgaggcttttgctagtagggctaagattgttcatattgatattgactcggctgagattgggaagaataagactcctcatgtgtctgtgtgtggtgatgttaagctggctttgcaagggatgaataaggttcttgagaaccgagcggaggagcttaaacttgattttggagtttggaggaatgagttgaacgtacagaaacagaagtttccgttgagctttaagacgtttggggaagctattcctccacagtatgcgattaaggtccttgatgagttgactgatggaaaagccataataagtactggtgtcgggcaacatcaaatgtgggcggcgcagttctacaattacaagaaaccaaggcagtggctatcatcaggaggccttggagctatgggatttggacttcctgctgcgattggagcgtctgttgctaaccctgatgcgatagttgtggatattgacggagatggaagttttataatgaatgtgcaagagctagccactattcgtgtagagaatcttccagtgaaggtacttttattaaacaaccagcatcttggcatggttatgcaatgggaagatcggttctacaaagctaaccgagctcacacatttctcggggacccggctcaggaggacgagatattcccgaacatgttgctgtttgcagcagcttgcgggattccagcggcgagggtgacaaagaaagcagatctccgagaagctattcagacaatgctggatacaccaggaccttacctgttggatgtgatttgtccgcaccaagaacatgtgttgccgatgatcccgaatggtggcactttcaacgatgtcataacggaaggagatggccggattaaatactgagagatgaaaccggtgattatcagaaccttttatggtctttgtatgcatatggtaaaaaaacttagtttgcaatttcctgtttgttttggtaatttgagtttcttttagttgttgatctgcctgctttttggtttacgtcagactactactgctgttgttgtttggtttcctttctttcattttataaataaataatccggttcggtttactccttgtgactggctcagtttggttattgcgaaatgcgaatggtaaattgagtaattgaaattcgttattagggttctaagctgttttaacagtcactgggttaatatctctcgaatcttgcatggaaaatgctcttaccattggtttttaattgaaatgtgctcatatgggccgtggtttccaaattaaataaaactacgatgtcatcgagaagtaaaatcaactgtgtccacattatcagttttgtgtatacgatgaaatagggtaattcaaaatctagcttgatatgccttttggttcattttaaccttctgtaaacattttttcagattttgaacaagtaaatccaaaaaaaaaaaaaaaaatctcaactcaacactaaattattttaatgtataaaagatgcttaaaacatttggcttaaaagaaagaagctaaaaacatagagaactcttgtaaattgaagtatgaaaatatactgaattgggtattatatgaatttttctgatttaggattcacatgatccaaaaaggaaatccagaagcactaatcagacattggaagtaggattaatcagtgatcagtaactattaaattcaattaaccgcggacatctacatttttgaattgaaaaaaaattggtaattactctttctttttctccatattgaccatcatactcattgtaagacacacagatgaagaagtcaaatagctcgacattcctttggtctggtccagtgatgtcgactcacaaagcgaagattgcatgaatagactatcatgtgtttgctatgtatgagtactatggaatcgagggatcatttatttttcatgtcattgttcttggaggttgtgtggagaggcatcaccattaatcttctgaacatcagctatactaatcattaattggaatcagcgactgcaaattatggcagaggatgttggaaatagtaccaccacattcctaatccactatgctttccaagctgcagtaatttgagttggagacgggagttttgctcatttactcaggctcttggacaaacaaatgtgaaatcgcatatctgctcaatccgacatactaatcaaaggtcaagaattttttttagagaagatgaaaaccataatgaaagcatctaatgtttatagaaaattaccaaaaataccacatttatgaaaaattatcaaaaatacaatattcatagtatcacttttcatatttacaataaccacgtttgttctcaattttaacgaagaacaaacgacatttataatcctaagataattttttctaattcaaaaataattttcgattttcaaaaaaaaaattgaaaaaaaaattgaaaagaaaaattcaaaacaaaattatatgaaagttcaaatttgaaaaatgataattcaaaaacataaaaaaatatatttttatttaaataattatttattatatatatatagaccatggagcaagggggcgtgggccccggggcccaaactttttttcccatatataatgtcaacaaggacccgatttttagaaaaaaaaataggtataaaggagtccaaaaaattcaaattagttatatatgtatgtaaaaaaatattaaaatttattttgcccaagggcctatagattcattgggccgaccctggggttggggttgtgtgtgtgtcattctataattaaccggcaaaaactccaaaatttttatttaacaaatgtataa

SEQ ID NO: 299 - DNA, 43720 bp, Artificial sequence
  T-DNA insertion in LBFDAU Locus 1, including left and right border sequences
cagtcagcatcatcacaccaaaagttaggcccgaatagtttgaaattagaaagctcgcaattgaggtctacaggccaaattcgctcttagccgtacaatattactcaccggtgcgatgccccccatcgtaggtgaaggtggaaattaatggcgcgcctgatcactgattagtaactattacgtaagcctacgtagcgtcacgtgacgttagctaacgctacgtagcctcagctgacgttacgtaagcctacgtagcgtcacgtgagcttagctaacgctacctaggctcagctgacgttacgtaacgctagctagcgtcactcctgcagcaaatttacacattgccactaaacgtctaaacccttgtaatttgtttttgttttactatgtgtgttatgtatttgatttgcgataaatttttatatttggtactaaatttataacaccttttatgctaacgtttgccaacacttagcaatttgcaagttgattaattgattctaaattatttttgtcttctaaatacatatactaatcaactggaaatgtaaatatttgctaatatttctactataggagaattaaagtgagtgaatatggtaccacaaggtttggagatttaattgttgcaatgctgcatggatggcatatacaccaaacattcaataattcttgaggataataatggtaccacacaagatttgaggtgcatgaacgtcacgtggacaaaaggtttagtaatttttcaagacaacaatgttaccacacacaagttttgaggtgcatgcatggatgccctgtggaaagtttaaaaatattttggaaatgatttgcatggaagccatgtgtaaaaccatgacatccacttggaggatgcaataatgaagaaaactacaaatttacatgcaactagttatgcatgtagtctatataatgaggattttgcaatactttcattcatacacactcactaagttttacacgattataatttcttcatagccagtactgtttaagcttcactgtctctgaatcggcaaaggtaaacgtatcaattattctacaaacccttttatttttcttttgaattaccgtcttcattggttatatgataacttgataagtaaagcttcaataattgaatttgatctgtgtttttttggccttaatactaaatccttacataagctttgttgcttctcctcttgtgagttgagtgttaagttgtaataatggttcactttcagctttagaagaaaccatggaagttgttgagaggttctacggagagttggatggaaaggtttcccaaggagtgaacgctttgttgggatctttcggagttgagttgactgataccccaactactaagggattgccactcgttgattctccaactccaattgtgttgggagtgtctgtttacttgaccatcgtgatcggaggattgctttggatcaaggctagagatctcaagccaagagcttctgagccattcttgttgcaagctttggtgttggtgcacaacttgttctgcttcgctttgtctctttacatgtgcgtgggtatcgcttaccaagctatcacctggagatattccttgtggggaaacgcttataacccaaagcacaaggagatggctatcctcgtttacctcttctacatgtccaagtacgtggagttcatggataccgtgatcatgatcctcaagagatccaccagacagatttctttcctccacgtgtaccaccactcttctatctcccttatctggtgggctattgctcaccacgctccaggaggagaggcttattggagtgctgctctcaactctggagtgcacgtgttgatgtacgcttactacttcttggctgcttgcttgagatcttccccaaagctcaagaacaagtacctcttctggggaagatacctcacccaattccagatgttccagttcatgctcaacttggtgcaagcttactacgatatgaaaaccaacgctccatatccacaatggctcatcaagatcctcttctactacatgatctccctcttgttcctcttcggaaacttctacgtgcaaaagtacatcaagccatccgatggaaagcaaaagggagctaagaccgagtgatcgacaagctcgagtttctccataataatgtgtgagtagttcccagataagggaattagggttcctatagggtttcgctcatgtgttgagcatataagaaacccttagtatgtatttgtatttgtaaaatacttctatcaataaaatttctaattcctaaaaccaaaatccagtactaaaatccagatcccccgaattaattcggcgttaattcagctagctagcctcagctgacgttacgtaacgctaggtagcgtcacgtgacgttagctaacgctaggtagcgtcagctgagcttacgtaagcgcttagcagatatttggtgtctaaatgtttattttgtgatatgttcatgtttgaaatggtggtttcgaaaccagggacaacgttgggatctgatagggtgtcaaagagtattatggattgggacaatttcggtcatgagttgcaaattcaagtatatcgttcgattatgaaaattttcgaagaatatcccatttgagagagtctttacctcattaatgtttttagattatgaaattttatcatagttcatcgtagtctttttggtgtaaaggctgtaaaaagaaattgttcacttttgttttcgtttatgtgaaggctgtaaaagattgtaaaagactattttggtgttttggataaaatgatagtttttatagattcttttgcttttagaagaaatacatttgaaattttttccatgttgagtataaaataccgaaatcgattgaagatcatagaaatattttaactgaaaacaaatttataactgattcaattctctccatttttatacctatttaaccgtaatcgattctaatagatgatcgattttttatataatcctaattaaccaacggcatgtattggataattaaccgatcaactctcacccctaatagaatcagtattttccttcgacgttaattgatcctacactatgtaggtcatatccatcgttttaatttttggccaccattcaattctgtcttgcctttagggatgtgaatatgaacggccaaggtaagagaataaaaataatccaaattaaagcaagagaggccaagtaagataatccaaatgtacacttgtcattgccaaaattagtaaaatactcggcatattgtattcccacacattattaaaataccgtatatgtattggctgcatttgcatgaataatactacgtgtaagcccaaaagaacccacgtgtagcccatgcaaagttaacactcacgaccccattcctcagtctccactatataaacccaccatccccaatctcaccaaacccaccacacaactcacaactcactctcacaccttaaagaaccaatcaccaccaaaaaatttcacgatttggaatttgattcctgcgatcacaggtatgacaggttagattttgttttgtatagttgtatacatacttctttgtgatgttttgtttacttaatcgaatttttggagtgttttaaggtctctcgtttagaaatcgtggaaaatatcactgtgtgtgtgttcttatgattcacagtgtttatgggtttcatgttctttgttttatcattgaatgggaagaaatttcgttgggatacaaatttctcatgttcttactgatcgttattaggagtttggggaaaaaggaagagtttttttggttggttcgagtgattatgaggttatttctgtatttgatttatgagttaatggtcgttttaatgttgtagaccatgggaaaaggatctgagggaagatctgctgctagagagatgactgctgaggctaacggagataagagaaagaccatcctcattgagggagtgttgtacgatgctaccaacttcaaacacccaggaggttccattattaacttcctcaccgagggagaagctggagttgatgctacccaagcttacagagagttccatcagagatccggaaaggctgataagtacctcaagtccctcccaaagttggatgcttctaaggtggagtctaggttctctgctaaggagcaggctagaagggacgctatgaccagggattacgctgctttcagagaggagttggttgctgagggatacttcgatccatctatcccacacatgatctacagagtggtggagattgtggctttgttcgctttgtctttctggttgatgtctaaggcttctccaacctctttggttttgggagtggtgatgaacggaatcgctcaaggaagatgcggatgggttatgcacgagatgggacacggatctttcactggagttatctggctcgatgataggatgtgcgagttcttctacggagttggatgtggaatgtctggacactactggaagaaccagcactctaagcaccacgctgctccaaacagattggagcacgatgtggatttgaacaccttgccactcgttgctttcaacgagagagttgtgaggaaggttaagccaggatctttgttggctttgtggctcagagttcaggcttatttgttcgctccagtgtcttgcttgttgatcggattgggatggaccttgtacttgcacccaagatatatgctcaggaccaagagacacatggagtttgtgtggatcttcgctagatatatcggatggttctccttgatgggagctttgggatattctcctggaacttctgtgggaatgtacctctgctctttcggacttggatgcatctacatcttcctccaattcgctgtgtctcacacccacttgccagttaccaacccagaggatcaattgcactggcttgagtacgctgctgatcacaccgtgaacatctctaccaagtcttggttggttacctggtggatgtctaacctcaacttccaaatcgagcaccacttgttcccaaccgctccacaattcaggttcaaggagatctctccaagagttgaggctctcttcaagagacacaacctcccttactacgatttgccatacacctctgctgtttctactaccttcgctaacctctactctgttggacactctgttggagctgataccaagaagcaggattgactgctttaatgagatatgcgagacgcctatgatcgcatgatatttgctttcaattctgttgtgcacgttgtaaaaaacctgagcatgtgtagctcagatccttaccgccggtttcggttcattctaatgaatatatcacccgttactatcgtatttttatgaataatattctccgttcaatttactgattgtctacgtaggctcagctgagcttacctaaggctacgtaggctcacgtgacgttacgtaaggctacgtagcgtcacgtgagcttacctaactctagctagcctcacgtgaccttagctaacactaggtagcgtcagctcgacggcccggactgtatccaacttctgatctttgaatctctctgttccaacatgttctgaaggagttctaagacttttcagaaagcttgtaacatgctttgtagactttctttgaattactcttgcaaactctgattgaacctacgtgaaaactgctccagaagttctaaccaaattccgtcttgggaaggcccaaaatttattgagtacttcagtttcatggacgtgtcttcaaagatttataacttgaaatcccatcatttttaagagaagttctgttccgcaatgtcttagatctcattgaaatctacaactcttgtgtcagaagttcttccagaatcaacttgcatcatggtgaaaatctggccagaagttctgaacttgtcatatttcttaacagttagaaaaatttctaagtgtttagaattttgacttttccaaagcaaacttgacttttgactttcttaataaaacaaacttcatattctaacatgtcttgatgaaatgtgattcttgaaatttgatgttgatgcaaaagtcaaagtttgacttttcagtgtgcaattgaccattttgctcttgtgccaattccaaacctaaattgatgtatcagtgctgcaaacttgatgtcatggaagatcttatgagaaaattcttgaagactgagaggaaaaattttgtagtacaacacaaagaatcctgtttttcatagtcggactagacacattaacataaaacaccacttcattcgaagagtgattgaagaaggaaatgtgcagttacctttctgcagttcataagagcaacttacagacacttttactaaaatactacaaagaggaagattttaacaacttagagaagtaatgggagttaaagagcaacacattaagggggagtgttaaaattaatgtgttgtaaccaccactacctttagtaagtattataagaaaattgtaatcatcacattataattattgtccttatttaaaattatgataaagttgtatcattaagattgagaaaaccaaatagtcctcgtcttgatttttgaattattgttttctatgttacttttcttcaagcctatataaaaactttgtaatgctaaattgtatgctggaaaaaaatgtgtaatgaattgaatagaaattatggtatttcaaagtccaaaatccatcaatagaaatttagtacaaaacgtaactcaaaaatattctcttattttaaattttacaacaatataaaaatattctcttattttaaattttacaataatataatttatcacctgtcacctttagaataccaccaacaatattaatacttagatattttattcttaataattttgagatctctcaatatatctgatatttattttatatttgtgtcatattttcttatgttttagagttaacccttatatcttggtcaaactagtaattcaatatatgagtttgtgaaggacacattgacatcttgaaacattggttttaaccttgttggaatgttaaaggtaataaaacattcagaattatgaccatctattaatatacttcctttgtcttttaaaaaagtgtgcatgaaaatgctctatggtaagctagagtgtcttgctggcctgtgtatatcaattccatttccagatggtagaaactgccactacgaataattagtcataagacacgtatgttaacacacgtccccttgcatgttttttgccatatattccgtctctttctttttcttcacgtataaaacaatgaactaattaatagagcgatcaagctgaacagttctttgctttcgaagttgccgcaacctaaacaggtttttccttcttctttcttcttattaactacgaccttgtcctttgcctatgtaaaattactaggttttcatcagttacactgattaagttcgttatagtggaagataaaatgccctcaaagcattttgcaggatatctttgatttttcaaagatatggaactgtagagtttgatagtgttcttgaatgtggttgcatgaagtttttttggtctgcatgttattttttcctcgaaatatgttttgagtccaacaagtgattcacttgggattcagaaagttgttttctcaatatgtaacagtttttttctatggagaaaaatcatagggaccgttggttttggcttctttaattttgagctcagattaaacccattttacccggtgttcttggcagaattgaaaacagtacgtagtaccgcgcctaccatgtgtgttgagaccgagaacaacgatggaatccctactgtggagatcgctttcgatggagagagagaaagagctgaggctaacgtgaagttgtctgctgagaagatggaacctgctgctttggctaagaccttcgctagaagatacgtggttatcgagggagttgagtacgatgtgaccgatttcaaacatcctggaggaaccgtgattttctacgctctctctaacactggagctgatgctactgaggctttcaaggagttccaccacagatctagaaaggctaggaaggctttggctgctttgccttctagacctgctaagaccgctaaagtggatgatgctgagatgctccaggatttcgctaagtggagaaaggagttggagagggacggattcttcaagccttctcctgctcatgttgcttacagattcgctgagttggctgctatgtacgctttgggaacctacttgatgtacgctagatacgttgtgtcctctgtgttggtttacgcttgcttcttcggagctagatgtggatgggttcaacacgagggaggacactcttctttgaccggaaacatctggtgggataagagaatccaagctttcactgctggattcggattggctggatctggagatatgtggaactccatgcacaacaagcaccacgctactcctcaaaaagtgaggcacgatatggatttggataccactcctgctgttgctttcttcaacaccgctgtggaggataatagacctaggggattctctaagtactggctcagattgcaagcttggaccttcattcctgtgacttctggattggtgttgctcttctggatgttcttcctccacccttctaaggctttgaagggaggaaagtacgaggagcttgtgtggatgttggctgctcacgtgattagaacctggaccattaaggctgttactggattcaccgctatgcaatcctacggactcttcttggctacttcttgggtttccggatgctacttgttcgctcacttctctacttctcacacccacttggatgttgttcctgctgatgagcacttgtcttgggttaggtacgctgtggatcacaccattgatatcgatccttctcagggatgggttaactggttgatgggatacttgaactgccaagtgattcaccacctcttcccttctatgcctcaattcagacaacctgaggtgtccagaagattcgttgctttcgctaagaagtggaacctcaactacaaggtgatgacttatgctggagcttggaaggctactttgggaaacctcgataatgtgggaaagcactactacgtgcacggacaacactctggaaagaccgcttgattaatgaaggccgcctcgaccgtaccccctgcagatagactatactatgttttagcctgcctgctggctagctactatgttatgttatgttgtaaaataaacacctgctaaggtatatctatctatattttagcatggctttctcaataaattgtctttccttatcgtttactatcttatacctaataatgaaataataatatcacatatgaggaacggggcaggtttaggcatatatatacgagtgtagggcggagtggggctacgtagcgtcacgtgacgttacctaagcctaggtagcctcagctgacgttacgtaacgctaggtaggctcagctgacacgggcaggacatagggactactacaagcatagtatgcttcagacaaagagctaggaaagaactcttgatggaggttaagagaaaaaagtgctagaggggcatagtaatcaaacttgtcaaaaccgtcatcatgatgagggatgacataatataaaaagttgactaaggtcttggtagtactctttgattagtattatatattggtgagaacatgagtcaagaggagacaagaaaccgaggaaccatagtttagcaacaagatggaagttgcaaagttgagctagccgctcgattagttacatctcctaagcagtactacaaggaatggtctctatactttcatgtttagcacatggtagtgcggattgacaagttagaaacagtgcttaggagacaaagagtcagtaaaggtattgaaagagtgaagttgatgctcgacaggtcaggagaagtccctccgccagatggtgactaccaaggggttggtatcagctgagacccaaataagattcttcggttgaaccagtggttcgaccgagactcttagggtgggatttcactgtaagatttgtgcattttgttgaatataaattgacaattttttttatttaattatagattatttagaatgaattacatatttagtttctaacaaggatagcaatggatgggtatgggtacaggttaaacatatctattacccacccatctagtcgtcgggttttacacgtacccacccgtttacataaaccagaccggaattttaaaccgtacccgtccgttagcgggtttcagatttacccgtttaatcgggtaaaacctgattactaaatatatattttttatttgataaacaaaacaaaaatgttaatattttcatattggatgcaattttaagaaacacatattcataaatttccatatttgtaggaaaataaaaagaaaaatatattcaagaacacaaatttcaccgacatgacttttattacagagttggaattagatctaacaattgaaaaattaaaattaagatagaatatgttgaggaacatgacatagtataatgctgggttacccgtcgggtaggtatcgaggcggatactactaaatccatcccactcgctatccgataatcactggtttcgggtatacccattcccgtcaacaggcctttttaaccggataatttcaacttatagtgaatgaattttgaataaatagttagaataccaaaatcctggattgcatttgcaatcaaattttgtgaaccgttaaattttgcatgtacttgggatagatataatagaaccgaattttcattagtttaatttataacttactttgttcaaagaaaaaaaatatctatccaatttacttataataaaaaataatctatccaagttacttattataatcaacttgtaaaaaggtaagaatacaaatgtggtagcgtacgtgtgattatatgtgacgaaatgttatatctaacaaaagtccaaattcccatggtaaaaaaaatcaaaatgcatggcaggctgtttgtaaccttggaataagatgttggccaattctggagccgccacgtacgcaagactcagggccacgttctcttcatgcaaggatagtagaacaccactccacccacctcctatattagacctttgcccaaccctccccaactttcccatcccatccacaaagaaaccgacatttttatcataaatctggtgcttaaacactctggtgagttctagtacttctgctatgatcgatctcattaccatttcttaaatttctctccctaaatattccgagttcttgatttttgataacttcaggttttctctttttgataaatctggtctttccattttttttttttgtggttaatttagtttcctatgttcttcgattgtattatgcatgatctgtgtttggattctgttagattatgtattggtgaatatgtatgtgtttttgcatgtctggttttggtcttaaaaatgttcaaatctgatgatttgattgaagcttttttagtgttggtttgattcttctcaaaactactgttaatttactatcatgttttccaactttgattcatgatgacacttttgttctgctttgttataaaattttggttggtttgattttgtaattatagtgtaattttgttaggaatgaacatgttttaatactctgttttcgatttgtcacacattcgaattattaatcgataatttaactgaaaattcatggttctagatcttgttgtcatcagattatttgtttcgataattcatcaaatatgtagtccttttgctgatttgcgactgtttcattttttctcaaaattgttttttgttaagtttatctaacagttatcgttgtcaaaagtctctttcattttgcaaaatcttctttttttttttgtttgtaactttgttttttaagctacacatttagtctgtaaaatagcatcgaggaacagttgtcttagtagacttgcatgttcttgtaacttctatttgtttcagtttgttgatgactgctttgattttgtaggtcaaaggcgcaccctaccatggatgcttataacgctgctatggataagattggagctgctatcatcgattggagtgatccagatggaaagttcagagctgatagggaggattggtggttgtgcgatttcagatccgctatcaccattgctctcatctacatcgctttcgtgatcttgggatctgctgtgatgcaatctctcccagctatggacccataccctatcaagttcctctacaacgtgtctcaaatcttcctctgcgcttacatgactgttgaggctggattcctcgcttataggaacggatacaccgttatgccatgcaaccacttcaacgtgaacgatccaccagttgctaacttgctctggctcttctacatctccaaagtgtgggatttctgggataccatcttcattgtgctcggaaagaagtggagacaactctctttcttgcacgtgtaccaccacaccaccatcttcctcttctactggttgaacgctaacgtgctctacgatggagatatcttcttgaccatcctcctcaacggattcattcacaccgtgatgtacacctactacttcatctgcatgcacaccaaggattctaagaccggaaagtctttgccaatctggtggaagtcatctttgaccgctttccaactcttgcaattcaccatcatgatgtcccaagctacctacttggttttccacggatgcgataaggtttccctcagaatcaccatcgtgtacttcgtgtacattctctcccttttcttcctcttcgctcagttcttcgtgcaatcctacatggctccaaagaagaagaagtccgcttgatgttaatgaaggccgcagatatcagatctggtcgacctagaggatccccggccgcaaagataataacaaaagcctactatataacgtacatgcaagtattgtatgatattaatgtttttacgtacgtgtaaacaaaaataattacgtttgtaacgtatggtgatgatgtggtgcactaggtgtaggccttgtattaataaaaagaagtttgttctatatagagtggtttagtacgacgatttatttactagtcggattggaatagagaaccgaattcttcaatccttgcttttgatcaagaattgaaaccgaatcaaatgtaaaagttgatatatttgaaaaacgtattgagcttatgaaaatgctaatactctcatctgtatggaaaagtgactttaaaaccgaacttaaaagtgacaaaaggggaatatcgcatcaaaccgaatgaaaccgatctacgtaggctcagctgagcttagctaagcctacctagcctcacgtgagattatgtaaggctaggtagcgtcacgtgacgttacctaacactagctagcgtcagctgagcttagctaaccctacgtagcctcacgtgagcttacctaacgctacgtagcctcacgtgactaaggatgacctacccattcttgagacaaatgttacattttagtatcagagtaaaatgtgtacctataactcaaattcgattgacatgtatccattcaacataaaattaaaccagcctgcacctgcatccacatttcaagtattttcaaaccgttcggctcctatccaccgggtgtaacaagacggattccgaatttggaagattttgactcaaattcccaatttatattgaccgtgactaaatcaactttaacttctataattctgattaagctcccaatttatattcccaacggcactacctccaaaatttatagactctcatccccttttaaaccaacttagtaaacgttttttttttaattttatgaagttaagtttttaccttgtttttaaaaagaatcgttcataagatgccatgccagaacattagctacacgttacacatagcatgcagccgcggagaattgtttttcttcgccacttgtcactcccttcaaacacctaagagcttctctctcacagcacacacatacaatcacatgcgtgcatgcattattacacgtgatcgccatgcaaatctcctttatagcctataaattaactcatcggcttcactctttactcaaaccaaaactcatcaatacaaacaagattaaaaacatttcacgatttggaatttgattcctgcgatcacaggtatgacaggttagattttgttttgtatagttgtatacatacttctttgtgatgttttgtttacttaatcgaatttttggagtgttttaaggtctctcgtttagaaatcgtggaaaatatcactgtgtgtgtgttcttatgattcacagtgtttatgggtttcatgttctttgttttatcattgaatgggaagaaatttcgttgggatacaaatttctcatgttcttactgatcgttattaggagtttggggaaaaaggaagagtttttttggttggttcgagtgattatgaggttatttctgtatttgatttatgagttaatggtcgttttaatgttgtagaccgccatggctattttgaaccctgaggctgattctgctgctaacctcgctactgattctgaggctaagcaaagacaattggctgaggctggatacactcacgttgagggtgctcctgctcctttgcctttggagttgcctcacttctctctcagagatctcagagctgctattcctaagcactgcttcgagagatctttcgtgacctccacctactacatgatcaagaacgtgttgacttgcgctgctttgttctacgctgctaccttcattgatagagctggagctgctgcttatgttttgtggcctgtgtactggttcttccagggatcttacttgactggagtgtgggttatcgctcacgagtgtggacaccaggcttattgctcttctgaggtggtgaacaacttgattggactcgtgttgcactctgctttgttggtgccttaccactcttggagaatctctcacagaaagcaccactccaacactggatcttgcgagaacgatgaggttttcgttcctgtgaccagatctgtgttggcttcttcttggaacgagaccttggaggattctcctctctaccaactctaccgtatcgtgtacatgttggttgttggatggatgcctggatacctcttcttcaacgctactggacctactaagtactggggaaagtctaggtctcacttcaacccttactccgctatctatgctgatagggagaggtggatgatcgtgctctccgatattttcttggtggctatgttggctgttttggctgctttggtgcacactttctccttcaacacgatggtgaagttctacgtggtgccttacttcattgtgaacgcttacttggtgttgattacctacctccaacacaccgatacctacatccctcacttcagagagggagagtggaattggttgagaggagctttgtgcactgtggatagatcatttggtccattcctcgattctgtggtgcatagaatcgtggatacccacgtttgccaccatatcttctccaagatgcctttctatcactgcgaggaggctaccaacgctattaagcctctcctcggaaagttctacttgaaggatactactcctgttcctgttgctctctggagatcttacacccactgcaagttcgttgaggatgatggaaaggtggtgttctacaagaacaagttatagttaatgaataattgattggttcgagtattatggcattgggaaaactgtttttcttgtaccatttgttgtgcttgtaatttactgtgttttttattcggttttcgctatcgaactgtgaaatggaaatggatggagaagagttaatgaatgatatggtccttttgttcattctcaaattaatattatttgttttttctcttatttgttgtgtgttgaatttgaaattataagagatatgcaaacattttgttttgagtaaaaatgtgtcaaatcgtggcctctaatgaccgaagttaatatgaggagtaaaacacttgtagttgtaccattatgcttattcactaggcaacaaatatattttcagacctagaaaagctgcaaatgttactgaatacaagtatgtcctcttgtgttttagacatttatgaactttcctttatgtaattttccagaatccttgtcagattctaatcattgctttataattatagttatactcatggatttgtagttgagtatgaaaatattttttaatgcattttatgacttgccaattgattgacaacatgcatcaatctagctagcctcagctgacgttacgtaacgctaggtagcgtcacgtgacgttagctaacgctaggtagcgtcagctgagcttacgtaagcgcacagatgaatactagctgttgttcacagttctagtgtctcctcattacgtgaattcaagctacgatcactatctcaactcctacataaacatcagaatgctacaaaactatgcacaaaaacaaaagctacatctaatacgtgaatcaattactctcatcacaagaaagaagatttcaatcaccgtcgagaaggaggattcagttaattgaatcaaagttccgatcaaactcgaagactggtgagcacgaggacgacgaagaagagtgtctcgaagatacaacaagcaagaaatctactgagtgacctcctgaagttattggcgcgattgagagaatcaatccgaattaatttcggggaaaaagataaattagatactaagcgatgggcttgggctgggctaagaaacaggtggcaattgggctggaggaccccgcgattcatagcttccgatagcccaaaaaaaaacggataacatatttatcgggtatttgaatttcagtgaaataagatattttctttttgttaggaaaattttagaaaataatggaaattaaatagcgattatgttacaagatacgatcagcatcgggcagtgcaaaatgctatagcttcccaagatttgatccttttgggttatctcctaatgacaattagtttaggattttgaaacttatattaatactattatccgacaacacttgtttcagcttcttattttaacattttttgtttttttctattcttcttcccatcagcattttctttttaaaaaattgaatactttaactttttaaaaatttcacaatgatcagatgatattatggaagatctcaagagttaaatgtatccatcttggggcattaaaaccggtgtacgggatgataaatacagactttatatcatatgatagctcagtaattcatatttatcacgttgctaaaaaaattataaggtactagtagtcaacaaaatcaattaaagagaaagaaagaaacgcatgtgaagagagtttacaactggaaaagtaaaataaaaattaacgcatgttgaatgctgacatgtcagtatgtccatgaatccacgtatcaagcgccattcatcgatcgtcttcctctttctaaatgaaaacaacttcacacatcacaacaaacaatacacacaagaccccctctctctcgttgtctctctgccagcgaccaaatcgaagcttgagaagaacaagaaggggtcaaaccatggcttctacatctgctgctcaagacgctgctccttacgagttcccttctctcactgagatcaagagggctcttccttctgagtgtttcgaggcttctgttcctctttctctctactacaccgctagatctcttgctcttgctggatctctcgctgttgctctctcttacgctagagctttgcctcttgttcaggctaacgctcttcttgatgctactctctgcactggatacgttcttctccagggaatcgttttctggggattcttcaccgttggtcacgattgtggacacggagctttctctagatctcacgtgctcaacttctctgttggaaccctcatgcactctatcatccttacccctttcgagtcttggaagctctctcacagacaccaccacaagaacaccggaaacatcgataaggacgagatcttctaccctcaaagagaggctgattctcaccctgtttctagacaccttgtgatgtctcttggatctgcttggttcgcttaccttttcgctggattccctcctagaaccatgaaccacttcaacccttgggaggctatgtatgttagaagagtggctgctgtgatcatctctctcggagttcttttcgctttcgctggactctactcttacctcaccttcgttcttggattcaccactatggctatctactacttcggacctctcttcatcttcgctaccatgcttgttgttaccactttcctccaccacaacgatgaggagacaccttggtacgctgattctgagtggacttacgtgaagggaaacctctcttctgtggacagatcttacggtgctctcatcgacaaccttagccacaacatcggaactcaccagatccaccacctcttccctatcatccctcactacaagctcaacgatgctactgctgctttcgctaaggctttccctgagcttgttaggaaaaacgctgctcctatcatcccaactttcttcaggatggctgctatgtacgctaagtacggagttgttgacactgatgctaagaccttcactctcaaggaggctaaggctgctgctaagactaagtcatcttgatgattaatgaataattgattgtacatactatattttttgtttaccttgtgttagtttaatgttcagtgtcctctctttattgtggcacgtctctttgttgtatgttgtgtctatacaaagttgaaataatggaaagaaaaggaagagtgtaatttgttttgttttaagtgtttataaatatatatatataggtcatttagatagttctaggtttctataaaactctctctctggaagtagaatctgtttttgagaggatccagttgcctactaatctcccccaaaacccttcaagcttaaccttcctcttcacaacaacagaggaaacacatctcttgagctctgagttctcttctttgagcatgtctatcgctaaactcatctgccttatagcttccctcttctcttcatctctctctctcaccatttcgctgtaaaacttattctcctccctcagcctctctatctcttccttcagcatctcacaattcccaccataatcgactgaggatgattcaccgtcatcaacttcagactcagcgttgtagtcgtcatgagtctcacaagccttggaccaagaagactcatcatcgcaagttgatgatttatcatgatgcttctctgagccgtgtttgctacgtagcgtcacgtgacgttacctaagcctaggtagcctcagctgacgttacgtaacgctaggtaggctcagctgactgcagcaaatttacacattgccactaaacgtctaaacccttgtaatttgtttttgttttactatgtgtgttatgtatttgatttgcgataaatttttatatttggtactaaatttataacaccttttatgctaacgtttgccaacacttagcaatttgcaagttgattaattgattctaaattatttttgtcttctaaatacatatactaatcaactggaaatgtaaatatttgctaatatttctactataggagaattaaagtgagtgaatatggtaccacaaggtttggagatttaattgttgcaatgctgcatggatggcatatacaccaaacattcaataattcttgaggataataatggtaccacacaagatttgaggtgcatgaacgtcacgtggacaaaaggtttagtaatttttcaagacaacaatgttaccacacacaagttttgaggtgcatgcatggatgccctgtggaaagtttaaaaatattttggaaatgatttgcatggaagccatgtgtaaaaccatgacatccacttggaggatgcaataatgaagaaaactacaaatttacatgcaactagttatgcatgtagtctatataatgaggattttgcaatactttcattcatacacactcactaagttttacacgattataatttcttcatagccagtactgtttaagcttcactgtctctgaatcggcaaaggtaaacgtatcaattattctacaaacccttttatttttcttttgaattaccgtcttcattggttatatgataacttgataagtaaagcttcaataattgaatttgatctgtgtttttttggccttaatactaaatccttacataagctttgttgcttctcctcttgtgagttgagtgttaagttgtaataatggttcactttcagctttagaagaaacgcgccttccatggctacaaaggaggcttacgttttcccaactctcaccgagatcaagagatctctcccaaaggattgcttcgaggcttctgtgcctttgtctctctactacactgtgagatgcttggttattgctgtggctttgaccttcggattgaactacgctagagctttgccagaggttgagtctttctgggctttggatgctgctttgtgcactggatatatcctcctccagggaattgtgttctggggattcttcactgttggacacgatgctggacacggagctttctctagataccacctcttgaacttcgttgtgggaaccttcatgcactctctcatcttgaccccattcgagtcttggaagttgacccacagacaccaccacaagaacaccggaaacatcgatagagatgaggtgttctacccacagagaaaggctgatgatcacccattgtccaggaacttgatcttggctttgggagctgcttggcttgcttatttggtggagggattcccaccaagaaaggtgaaccacttcaacccattcgagccactttttgtgagacaagtgtccgctgtggttatctctttgctcgctcacttcttcgttgctggactctctatctacttgtctctccagttgggacttaagaccatggctatctactactacggaccagttttcgtgttcggatctatgttggtgattaccaccttcttgcaccacaacgatgaggagactccatggtatgctgattctgagtggacttacgtgaagggaaacttgtcctctgtggatagatcttacggtgctctcatcgataacctctcccacaacatcggaactcaccagatccaccacctcttcccaattatcccacactacaagctcaagaaggctactgctgctttccaccaagctttcccagagcttgtgagaaagtccgatgagccaatcatcaaggctttcttcagagtgggaaggttgtatgctaactacggagtggttgatcaagaggctaagctcttcactttgaaggaggctaaggctgctactgaagctgctgctaagaccaagtctacctgattaatgaatcgacaagctcgagtttctccataataatgtgtgagtagttcccagataagggaattagggttcctatagggtttcgctcatgtgttgagcatataagaaacccttagtatgtatttgtatttgtaaaatacttctatcaataaaatttctaattcctaaaaccaaaatccagtactaaaatccagatcccccgaattaattcggcgttaattcagctacgtaggctcagctgagcttacctaaggctacgtaggctcacgtgacgttacgtaaggctacgtagcgtcacgtgagcttacctaactctagctagcctcacgtgaccttagctaacactaggtagcgtcagcacagatgaatactagctgttgttcacagttctagtgtctcctcattacgtgaattcaagctacgatcactatctcaactcctacataaacatcagaatgctacaaaactatgcacaaaaacaaaagctacatctaatacgtgaatcaattactctcatcacaagaaagaagatttcaatcaccgtcgagaaggaggattcagttaattgaatcaaagttccgatcaaactcgaagactggtgagcacgaggacgacgaagaagagtgtctcgaagatacaacaagcaagaaatctactgagtgacctcctgaagttattggcgcgattgagagaatcaatccgaattaatttcggggaaaaagataaattagatactaagcgatgggcttgggctgggctaagaaacaggtggcaattgggctggaggaccccgcgattcatagcttccgatagcccaaaaaaaaacggataacatatttatcgggtatttgaatttcagtgaaataagatattttctttttgttaggaaaattttagaaaataatggaaattaaatagcgattatgttacaagatacgatcagcatcgggcagtgcaaaatgctatagcttcccaagatttgatccttttgggttatctcctaatgacaattagtttaggattttgaaacttatattaatactattatccgacaacacttgtttcagcttcttattttaacattttttgtttttttctattcttcttcccatcagcattttctttttaaaaaattgaatactttaactttttaaaaatttcacaatgatcagatgatattatggaagatctcaagagttaaatgtatccatcttggggcattaaaaccggtgtacgggatgataaatacagactttatatcatatgatagctcagtaattcatatttatcacgttgctaaaaaaattataaggtactagtagtcaacaaaatcaattaaagagaaagaaagaaacgcatgtgaagagagtttacaactggaaaagtaaaataaaaattaacgcatgttgaatgctgacatgtcagtatgtccatgaatccacgtatcaagcgccattcatcgatcgtcttcctctttctaaatgaaaacaacttcacacatcacaacaaacaatacacacaagaccccctctctctcgttgtctctctgccagcgaccaaatcgaagcttgagaagaacaagaaggggtcaaaccatgggaaaaggatctgagggaagatctgctgctagagagatgactgctgaggctaacggagataagagaaagaccatcctcattgagggagtgttgtacgatgctaccaacttcaaacacccaggaggttccattattaacttcctcaccgagggagaagctggagttgatgctacccaagcttacagagagttccatcagagatccggaaaggctgataagtacctcaagtccctcccaaagttggatgcttctaaggtggagtctaggttctctgctaaggagcaggctagaagggacgctatgaccagggattacgctgctttcagagaggagttggttgctgagggatacttcgatccatctatcccacacatgatctacagagtggtggagattgtggctttgttcgctttgtctttctggttgatgtctaaggcttctccaacctctttggttttgggagtggtgatgaacggaatcgctcaaggaagatgcggatgggttatgcacgagatgggacacggatctttcactggagttatctggctcgatgataggatgtgcgagttcttctacggagttggatgtggaatgtctggacactactggaagaaccagcactctaagcaccacgctgctccaaacagattggagcacgatgtggatttgaacaccttgccactcgttgctttcaacgagagagttgtgaggaaggttaagccaggatctttgttggctttgtggctcagagttcaggcttatttgttcgctccagtgtcttgcttgttgatcggattgggatggaccttgtacttgcacccaagatatatgctcaggaccaagagacacatggagtttgtgtggatcttcgctagatatatcggatggttctccttgatgggagctttgggatattctcctggaacttctgtgggaatgtacctctgctctttcggacttggatgcatctacatcttcctccaattcgctgtgtctcacacccacttgccagttaccaacccagaggatcaattgcactggcttgagtacgctgctgatcacaccgtgaacatctctaccaagtcttggttggttacctggtggatgtctaacctcaacttccaaatcgagcaccacttgttcccaaccgctccacaattcaggttcaaggagatctctccaagagttgaggctctcttcaagagacacaacctcccttactacgatttgccatacacctctgctgtttctactaccttcgctaacctctactctgttggacactctgttggagctgataccaagaagcaggattgatgattaatgaataattgattgtacatactatattttttgtttaccttgtgttagtttaatgttcagtgtcctctctttattgtggcacgtctctttgttgtatgttgtgtctatacaaagttgaaataatggaaagaaaaggaagagtgtaatttgttttgttttaagtgtttataaatatatatatataggtcatttagatagttctaggtttctataaaactctctctctggaagtagaatctgtttttgagaggatccagttgcctactaatctcccccaaaacccttcaagcttaaccttcctcttcacaacaacagaggaaacacatctcttgagctctgagttctcttctttgagcatgtctatcgctaaactcatctgccttatagcttccctcttctcttcatctctctctctcaccatttcgctgtaaaacttattctcctccctcagcctctctatctcttccttcagcatctcacaattcccaccataatcgactgaggatgattcaccgtcatcaacttcagactcagcgttgtagtcgtcatgagtctcacaagccttggaccaagaagactcatcatcgcaagttgatgatttatcatgatgcttctctgagccgtgtttgctacctagagtcagctgagcttagctaacgctagctagtgtcagctgacgttacgtaaggctaactagcgtcacgtgaccttacgtaacgctacgtaggctcagctgagcttagctaaccctagctagtgtcacgtgagcttacgctactatagaaaatgtgttatatcgacatgaccagacaaaggggcaacagttaacaaaacaattaattctttcatttgagattaaggaaggtaaggtactaaaaagattaaaaaaaatgagcttatctctttgtttctgtaataataatataagtgtgataaacttttaatataataattgtaattaggttttctacagatgagcaccactcagagacaagataagaagaaaacaattttgttaaacatgattatagaaacttttagttaagtcttgaagtatcaatataacaaaaaaaagtacacacgactatgacaataaacccactaccgtcaggttatcatttcgatgaaatgttttgatatcattaaatataacagtcacaaaaaatcatctaattataacaatataacttatacatatatttaactaaaaacttagagtttttgtaatgattctaattgatgattagagtttatagaaatacaattaaataaaaaatataattttaaaaaaacatagtaaagtcaatgagatcctctctgacctcagtgatcatttagtcatgtatgtacaacaatcattgttcatcacatgactgtaaaataaataaggataaacttgggaatatatataatatattgtattaaataaaaaagggaaatacaaatatcaattttagattcccgagttgacacaactcaccatgcacgctgccacctcagctcccagctctcgtcacatgtctcatgtcagttaggtctttggtttttagtctttgacacaactcgccatgcatgttgccacgtgagctcgttcctcttcccatgatctcaccactgggcatgcatgctgccacctcagctggcacctcttctctatatgtccctagaggccatgcacagtgccacctcagcactcctctcagaacccatacgtacctgccaatcggcttctctccataaatatctatttaaattataactaattatttcatatacttaattgatgacgtggatgcattgccatcgttgtttaataattgttaattacgacatgataaataaaatgaaagtaaaaagtacgaaagattttccatttgttgttgtataaatagagaagtgagtgatgcataatgcatgaatgcatgaccgcgccaccatgactgttggatacgacgaggagatcccattcgagcaagttagggctcataacaagccagacgacgcttggtgtgctattcacggacacgtgtacgacgttaccaagttcgcttcagttcacccaggaggagatattatcttgctcgctgctggaaaggaagctactgtcctctacgagacctaccatgttagaggagtgtctgacgctgtgctcagaaagtacagaataggaaagttgccagacggacaaggaggagctaacgagaaggagaagagaaccttgtctggattgtcctctgcttcttactacacctggaactccgatttctacagagtgatgagggagagagttgtggctagattgaaggagagaggaaaggctagaagaggaggatacgaactctggatcaaggctttcttgctccttgttggattctggtcctctctttactggatgtgcaccctcgatccatctttcggagctatcttggctgctatgtctttgggagtgttcgctgcttttgttggaacctgcatccaacacgatggaaaccacggagctttcgctcaatctagatgggttaacaaggtggcaggatggactttggatatgatcggagcttctggaatgacttgggagttccaacacgtgttgggacaccacccatacactaacttgatcgaggaggagaacggattgcaaaaggtgtccggaaagaagatggataccaagttggctgatcaagagtctgatccagatgtgttctccacctacccaatgatgagattgcacccttggcaccagaagaggtggtatcacaggttccagcacatctacggacctttcatcttcggattcatgaccatcaacaaggtggtgactcaagatgttggagtggtgttgagaaagagactcttccaaatcgatgctgagtgcagatatgcttccccaatgtacgttgctaggttctggattatgaaggctttgaccgtgttgtatatggttgctttgccttgttatatgcaaggaccttggcacggattgaaactcttcgctatcgctcacttcacttgcggagaggttttggctaccatgttcatcgtgaaccacattatcgagggagtgtcttacgcttctaaggatgctgttaagggaactatggctccaccaaagactatgcacggagtgaccccaatgaacaacactagaaaggaggttgaggctgaggcttctaagtctggagctgtggttaagtctgtgccattggatgattgggctgctgttcagtgccaaacctctgtgaactggtctgttggatcttggttttggaaccacttctctggaggactcaaccaccaaatcgagcaccacctcttcccaggattgtctcacgagacctactaccacatccaagacgtggttcaatctacctgtgctgagtacggagttccataccaacacgagccatctttgtggactgcttactggaagatgctcgaacaccttagacaattgggaaacgaggagactcacgagtcatggcagagagctgcttgattaatgaactaagactcccaaaaccaccttccctgtgacagttaaaccctgcttatacctttcctcctaataatgttcatctgtcacacaaactaaaataaataaaatgggagcaataaataaaatgggagctcatatatttacaccatttacactgtctattattcaccatgccaattattacttcataattttaaaattatgtcatttttaaaaattgcttaatgatggaaaggattattataagttaaaagtataacatagataaactaaccacaaaacaaatcaatataaactaacttactctcccatctaatttttatttaaatttctttacacttctcttccatttctatttctacaacattatttaacatttttattgtatttttcttactttctaactctattcatttcaaaaatcaatatatgtttatcaccacctctctaaaaaaaactttacaatcattggtccagaaaagttaaatcacgagatggtcattttagcattaaaacaacgattcttgtatcactatttttcagcatgtagtccattctcttcaaacaaagacagcggctatataatcgttgtgttatattcagtctaaaacaactagctagcctcagctgacgttacgtaacgctaggtagcgtcacgtgacgttagctaacgctaggtagcgtcagctgagcttacgtaagcgccacgggcaggacatagggactactacaagcatagtatgcttcagacaaagagctaggaaagaactcttgatggaggttaagagaaaaaagtgctagaggggcatagtaatcaaacttgtcaaaaccgtcatcatgatgagggatgacataatataaaaagttgactaaggtcttggtagtactctttgattagtattatatattggtgagaacatgagtcaagaggagacaagaaaccgaggaaccatagtttagcaacaagatggaagttgcaaagttgagctagccgctcgattagttacatctcctaagcagtactacaaggaatggtctctatactttcatgtttagcacatggtagtgcggattgacaagttagaaacagtgcttaggagacaaagagtcagtaaaggtattgaaagagtgaagttgatgctcgacaggtcaggagaagtccctccgccagatggtgactaccaaggggttggtatcagctgagacccaaataagattcttcggttgaaccagtggttcgaccgagactcttagggtgggatttcactgtaagatttgtgcattttgttgaatataaattgacaattttttttatttaattatagattatttagaatgaattacatatttagtttctaacaaggatagcaatggatgggtatgggtacaggttaaacatatctattacccacccatctagtcgtcgggttttacacgtacccacccgtttacataaaccagaccggaattttaaaccgtacccgtccgttagcgggtttcagatttacccgtttaatcgggtaaaacctgattactaaatatatattttttatttgataaacaaaacaaaaatgttaatattttcatattggatgcaattttaagaaacacatattcataaatttccatatttgtaggaaaataaaaagaaaaatatattcaagaacacaaatttcaccgacatgacttttattacagagttggaattagatctaacaattgaaaaattaaaattaagatagaatatgttgaggaacatgacatagtataatgctgggttacccgtcgggtaggtatcgaggcggatactactaaatccatcccactcgctatccgataatcactggtttcgggtatacccattcccgtcaacaggcctttttaaccggataatttcaacttatagtgaatgaattttgaataaatagttagaataccaaaatcctggattgcatttgcaatcaaattttgtgaaccgttaaattttgcatgtacttgggatagatataatagaaccgaattttcattagtttaatttataacttactttgttcaaagaaaaaaaatatctatccaatttacttataataaaaaataatctatccaagttacttattataatcaacttgtaaaaaggtaagaatacaaatgtggtagcgtacgtgtgattatatgtgacgaaatgttatatctaacaaaagtccaaattcccatggtaaaaaaaatcaaaatgcatggcaggctgtttgtaaccttggaataagatgttggccaattctggagccgccacgtacgcaagactcagggccacgttctcttcatgcaaggatagtagaacaccactccacccacctcctatattagacctttgcccaaccctccccaactttcccatcccatccacaaagaaaccgacatttttatcataaatcagggtttcgtttttgtttcatcgataaactcaaaggtgatgattttagggtcttgtgagtgtgcttttttgtttgattctactgtagggtttatgttctttagctcataggttttgtgtatttcttagaaatgtggcttctttaatctctgggtttgtgactttttgtgtggtttctgtgtttttcatatcaaaaacctattttttccgagtttttttttacaaattcttactctcaagcttgaatacttcacatgcagtgttcttttgtagattttagagttaatgtgttaaaaagtttggatttttcttgcttatagagcttcttcactttgattttgtgggtttttttgttttaaaggtgagatttttgatgaggtttttgcttcaaagatgtcacctttctgggtttgtcttttgaataaagctatgaactgtcacatggctgacgcaattttgttactatgtcatgaaagctgacgtttttccgtgttatacatgtttgcttacacttgcatgcgtcaaaaaaattggggctttttagttttagtcaaagattttacttctcttttgggatttatgaaggaaagttgcaaactttctcaaattttaccatttttgctttgatgtttgtttagattgcgacagaacaaactcatatatgttgaaatttttgcttggttttgtataggattgtgtcttttgcttataaatgttgaaatctgaactttttttttgtttggtttctttgagcaggagataaggcgcaccaccatggcttctacatctgctgctcaagacgctgctccttacgagttcccttctctcactgagatcaagagggctcttccttctgagtgtttcgaggcttctgttcctctttctctctactacaccgctagatctcttgctcttgctggatctctcgctgttgctctctcttacgctagagctttgcctcttgttcaggctaacgctcttcttgatgctactctctgcactggatacgttcttctccagggaatcgttttctggggattcttcaccgttggtcacgattgtggacacggagctttctctagatctcacgtgctcaacttctctgttggaaccctcatgcactctatcatccttacccctttcgagtcttggaagctctctcacagacaccaccacaagaacaccggaaacatcgataaggacgagatcttctaccctcaaagagaggctgattctcaccctgtttctagacaccttgtgatgtctcttggatctgcttggttcgcttaccttttcgctggattccctcctagaaccatgaaccacttcaacccttgggaggctatgtatgttagaagagtggctgctgtgatcatctctctcggagttcttttcgctttcgctggactctactcttacctcaccttcgttcttggattcaccactatggctatctactacttcggacctctcttcatcttcgctaccatgcttgttgttaccactttcctccaccacaacgatgaggagacaccttggtacgctgattctgagtggacttacgtgaagggaaacctctcttctgtggacagatcttacggtgctctcatcgacaaccttagccacaacatcggaactcaccagatccaccacctcttccctatcatccctcactacaagctcaacgatgctactgctgctttcgctaaggctttccctgagcttgttaggaaaaacgctgctcctatcatcccaactttcttcaggatggctgctatgtacgctaagtacggagttgttgacactgatgctaagaccttcactctcaaggaggctaaggctgctgctaagactaagtcatcttgatgattaatgaaggccgcagatatcagatctggtcgacctagaggatccccggccgcaaagataataacaaaagcctactatataacgtacatgcaagtattgtatgatattaatgtttttacgtacgtgtaaacaaaaataattacgtttgtaacgtatggtgatgatgtggtgcactaggtgtaggccttgtattaataaaaagaagtttgttctatatagagtggtttagtacgacgatttatttactagtcggattggaatagagaaccgaattcttcaatccttgcttttgatcaagaattgaaaccgaatcaaatgtaaaagttgatatatttgaaaaacgtattgagcttatgaaaatgctaatactctcatctgtatggaaaagtgactttaaaaccgaacttaaaagtgacaaaaggggaatatcgcatcaaaccgaatgaaaccgatctacgtaggctcagctgagcttacctaaggctacgtaggctcacgtgacgttacgtaaggctacgtagcgtcacgtgagcttacctaactctagctagcctcacgtgaccttagctaacactaggtagcgtcagcttagcagatatttggtgtctaaatgtttattttgtgatatgttcatgtttgaaatggtggtttcgaaaccagggacaacgttgggatctgatagggtgtcaaagagtattatggattgggacaatttcggtcatgagttgcaaattcaagtatatcgttcgattatgaaaattttcgaagaatatcccatttgagagagtctttacctcattaatgtttttagattatgaaattttatcatagttcatcgtagtctttttggtgtaaaggctgtaaaaagaaattgttcacttttgttttcgtttatgtgaaggctgtaaaagattgtaaaagactattttggtgttttggataaaatgatagtttttatagattcttttgcttttagaagaaatacatttgaaattttttccatgttgagtataaaataccgaaatcgattgaagatcatagaaatattttaactgaaaacaaatttataactgattcaattctctccatttttatacctatttaaccgtaatcgattctaatagatgatcgattttttatataatcctaattaaccaacggcatgtattggataattaaccgatcaactctcacccctaatagaatcagtattttccttcgacgttaattgatcctacactatgtaggtcatatccatcgttttaatttttggccaccattcaattctgtcttgcctttagggatgtgaatatgaacggccaaggtaagagaataaaaataatccaaattaaagcaagagaggccaagtaagataatccaaatgtacacttgtcattgccaaaattagtaaaatactcggcatattgtattcccacacattattaaaataccgtatatgtattggctgcatttgcatgaataatactacgtgtaagcccaaaagaacccacgtgtagcccatgcaaagttaacactcacgaccccattcctcagtctccactatataaacccaccatccccaatctcaccaaacccaccacacaactcacaactcactctcacaccttaaagaaccaatcaccaccaaaaaaagttctttgctttcgaagttgccgcaacctaaacaggtttttccttcttctttcttcttattaactacgaccttgtcctttgcctatgtaaaattactaggttttcatcagttacactgattaagttcgttatagtggaagataaaatgccctcaaagcattttgcaggatatctttgatttttcaaagatatggaactgtagagtttgatagtgttcttgaatgtggttgcatgaagtttttttggtctgcatgttattttttcctcgaaatatgttttgagtccaacaagtgattcacttgggattcagaaagttgttttctcaatatgtaacagtttttttctatggagaaaaatcatagggaccgttggttttggcttctttaattttgagctcagattaaacccattttacccggtgttcttggcagaattgaaaacagtacgtagtaccgcgcctaccatgccacctagtgctgctagtgaaggtggtgttgctgaacttagagctgctgaagttgctagctacactagaaaggctgttgacgaaagacctgacctcactatagttggtgacgctgtttacgacgctaaggcttttagggacgagcaccctggtggtgctcacttcgttagccttttcggaggtagggacgctactgaggcttttatggaatatcaccgtagagcttggcctaaggctaggatgtctaagttcttcgttggttcacttgacgctagcgagaagcctactcaagctgattcagcttaccttagactttgcgctgaggttaacgctcttttgcctaagggtagcggaggattcgctcctcctagctactggcttaaggctgctgctcttgttgttgctgctgttagtatagagggttatatgctccttaggggtaagacccttttgcttagcgttttccttggactcgtgttcgcttggataggacttaatattcagcacgacgctaatcacggtgctcttagtagacactcagtgattaactactgcctcggttacgctcaggattggataggtggtaatatggtgctttggcttcaagagcacgttgtgatgcaccacctccacactaacgacgttgacgctgatcctgatcaaaaggctcacggtgttcttagacttaagcctactgacggttggatgccttggcacgcacttcaacaactctatatccttcctggtgaggctatgtacgcttttaagcttcttttcttggacgcccttgagcttcttgcttggaggtgggagggtgagaagattagccctcttgctagagctttgttcgctcctgctgttgcttgtaagcttggattctgggctagattcgttgctctccctctctggcttcaacctactgttcacactgctttgtgtatctgtgctactgtgtgtactggtagcttctacctcgccttcttcttctttatctctcacaacttcgacggtgttggtagcgttggacctaagggatcacttcctagatcagctactttcgttcaacgtcaggttgagactagctctaacgttggtggttactggcttggagttcttaacggtggacttaactttcagatagagcaccacttgttccctaggcttcaccactcttactacgctcaaatagctcctgtggttaggactcacatagagaagctcggttttaagtaccgtcacttccctaccgttggatctaaccttagctcaatgcttcagcatatgggtaagatgggaactagacctggtgctgagaagggtggtaaggctgagtagtgattaatgaataattgattgctgctttaatgagatatgcgagacgcctatgatcgcatgatatttgctttcaattctgttgtgcacgttgtaaaaaacctgagcatgtgtagctcagatccttaccgccggtttcggttcattctaatgaatatatcacccgttactatcgtatttttatgaataatattctccgttcaatttactgattgtctacgtagcgtcacctgacgttacgtaaggctacctaggctcacgtgacgttacgtaacgctacgtagcgtcaggtgaggttagctaacgctagctagcctcacctgacgttaggtaaggctacgtagcgtcacctgagattagctaagcctacctagactcacgtgaccttaggtaacgctacgtagcgtcaaagctttacaacgctacacaaaacttataaccgtaatcaccattcattaacttaactactatcacatgcattcatgaattgaaacgagaaggatgtaaatagttgggaagttatctccacgttgaagagatcgttagcgagagctgaaagaccgagggaggagacgccgtcaacacggacagagtcgtcgaccctcacatgaagtaggaggaatctccgtgaggagccagagagacgtctttggtcttcggtttcgatccttgatctgacggagaagacgagagaagtgcgactggactccgtgaggaccaacagagtcgtcctcggtttcgatcgtcggtattggtggagaaggcggaggaatctccgtgacgagccagagagatgtcgtcggtcttcggtttcgatccttgatctgacggagaagacgagagaagtgcgacgagactccgtgaggaccaacagagttgtcctcggtttcgatcgtcggtttcggcggagaaggcggaggaatctccgtgaggagccagagagacgtcgttggtcttcggtttcgatccttgatctgttggagaagacgagacaagtgggacgagactcaacgacggagtcagagacgtcgtcggtcttcggtttcggccgagaaggcggagtcggtcttcggtttcggccgagaaggcggaggagacgtcttcgatttgggtctctcctcttgacgaagaaaacaaagaacacgagaaataatgagaaagagaacaaaagaaaaaaaaataaaaataaaaataaaatttggtcctcttatgtggtgacacgtggtttgaaacccaccaaataatcgatcacaaaaaacctaagttaaggatcggtaataacctttctaattaattttgatttatattaaatcactctttttatttataaaccccactaaattatgcgatattgattgtctaagtacaaaaattctctcgaattcaatacacatgtttcatatatttagccctgttcatttaatattactagcgcatttttaatttaaaattttgtaaacttttttggtcaaagaacatttttttaattagagacagaaatctagactctttatttggaataatagtaataaagatatattaggcaatgagtttatgatgttatgtttatatagtttatttcattttaaattgaaaagcattatttttatcgaaatgaatctagtatacaatcaatatttatgttttttcatcagatactttcctattttttggcacctttcatcggactactgatttatttcaatgtgtatgcatgcatgagcatgagtatacacatgtcttttaaaatgcatgtaaagcgtaacggaccacaaaagaggatccatacaaatacatctcatcgcttcctctactattctccgacacacacactgagcatggtgcttaaacactctggtgagttctagtacttctgctatgatcgatctcattaccatttcttaaatttctctccctaaatattccgagttcttgatttttgataacttcaggttttctctttttgataaatctggtctttccatttttttttttttgtggttaatttagtttcctatgttcttcgattgtattatgcatgatctgtgtttggattctgttagattatgtattggtgaatatgtatgtgtttttgcatgtctggttttggtcttaaaaatgttcaaatctgatgatttgattgaagcttttttagtgttggtttgattcttctcaaaactactgttaatttactatcatgttttccaactttgattcatgatgacacttttgttctgctttgttataaaattttggttggtttgattttgtaattatagtgtaattttgttaggaatgaacatgttttaatactctgttttcgatttgtcacacattcgaattattaatcgataatttaactgaaaattcatggttctagatcttgttgtcatcagattatttgtttcgataattcatcaaatatgtagtccttttgctgatttgcgactgtttcattttttctcaaaattgttttttgttaagtttatctaacagttatcgttgtcaaaagtctctttcattttgcaaaatcttctttttttttttgtttgtaactttgttttttaagctacacatttagtctgtaaaatagcatcgaggaacagttgtcttagtagacttgcatgttcttgtaacttctatttgtttcagtttgttgatgactgctttgattttgtaggtcaaaccgcgccatgtctgctagcggagctttgttgcctgctatagctttcgctgcttacgcttacgctacctacgcttatgctttcgagtggagccacgctaacggaatcgataacgtggatgctagagagtggattggagctttgtctttgagactccctgcaattgcaaccacaatgtacctcttgttctgccttgtgggacctagattgatggctaagagggaggcttttgatcctaagggatttatgctcgcttacaacgcttaccaaaccgctttcaacgttgtggtgctcggaatgttcgctagagagatctctggattgggacaacctgtttggggatctactatgccttggagcgataggaagtccttcaagattttgttgggagtgtggctccactacaacaataagtacctcgagttgttggatactgtgttcatggtggctaggaaaaagaccaagcagctctctttcttgcacgtgtaccaccacgctttgttgatttgggcttggtggcttgtttgtcacctcatggctaccaacgattgcatcgatgcttatttcggagctgcttgcaactctttcatccacatcgtgatgtactcctactacctcatgtctgctttgggaattaggtgcccttggaagagatatatcacccaggctcagatgttgcaattcgtgatcgtgttcgctcacgctgttttcgtgctcagacaaaagcactgccctgttactttgccttgggcacaaatgttcgtgatgacaaatatgttggtgctcttcggaaacttctacctcaaggcttactctaacaagtctaggggagatggagcttcttctgttaagcctgctgagactactagagcaccttctgtgagaagaaccaggtcaaggaagatcgattgatagttaatgaactaagtttgatgtatctgagtgccaacgtttactttgtctttcctttcttttattggttatgattagatgtttactatgttctctctttttcgttataaataaagaagttcaattcttctatagtttcaaacgcgattttaagcgtttctatttaggtttacatgatttcttttacaaaatcatctttaaaatacagtatatttttagttttcataaaatatttaaagaaatgaaagtttataaacattcactcctattctctaattaaggatttgtaaaacaaaaattttgtaagcatatcgatttatgcgttttgtcttaattagctcactaaataataaataatagcttatgttgtgggactgtttaattacctaacttagaactaaaatcaactctttgtgctagctagcctcagctgacgttacgtaacgctaggtagcgtcacgtgacgttagctaacgctaggtagcgtcagctgagcttacgtaagcgcttaattaaagtactgatatcggtaccaaatcgaatccaaaaattacggatatgaatataggcatatccgtatccgaattatccgtttgacagctagcaacgattgtacaattgcttctttaaaaaaggaagaaagaaagaaagaaaagaatcaacatcagcgttaacaaacggccccgttacggcccaaacggtcatatagagtaacggcgttaagcgttgaaagactcctatcgaaatacgtaaccgcaaacgtgtcatagtcagatcccctcttccttcaccgcctcaaacacaaaaataatcttctacagcctatatatacaacccccccttctatctctcctttctcacaattcatcatctttctttctctacccccaattttaagaaatcctctcttctcctcttcattttcaaggtaaatctctctctctctctctctctctgttattccttgttttaattaggtatgtattattgctagtttgttaatctgcttatcttatgtatgccttatgtgaatatctttatcttgttcatctcatccgtttagaagctataaatttgttgatttgactgtgtatctacacgtggttatgtttatatctaatcagatatgaatttcttcatattgttgcgtttgtgtgtaccaatccgaaatcgttgatttttttcatttaatcgtgtagctaattgtacgtatacatatggatctacgtatcaattgttcatctgtttgtgtttgtatgtatacagatctgaaaacatcacttctctcatctgattgtgttgttacatacatagatatagatctgttatatcattttttttattaattgtgtatatatatatgtgcatagatctggattacatgattgtgattatttacatgattttgttatttacgtatgtatatatgtagatctggactttttggagttgttgacttgattgtatttgtgtgtgtatatgtgtgttctgatcttgatatgttatgtatgtgcagctgaaccatggcggcggcaacaacaacaacaacaacatcttcttcgatctccttctccaccaaaccatctccttcctcctccaaatcaccattaccaatctccagattctccctcccattctccctaaaccccaacaaatcatcctcctcctcccgccgccgcggtatcaaatccagctctccctcctccatctccgccgtgctcaacacaaccaccaatgtcacaaccactccctctccaaccaaacctaccaaacccgaaacattcatctcccgattcgctccagatcaaccccgcaaaggcgctgatatcctcgtcgaggctttagaacgtcaaggcgtagaaaccgtattcgcttaccctggaggtacatcaatggagattcaccaagccttaacccgctcttcctcaatccgtaacgtccttcctcgtcacgaacaaggaggtgtattcgcagcagaaggatacgctcgatcctcaggtaaaccaggtatctgtatagccacttcaggtcccggagctacaaatctcgttagcggattagccgatgcgttgttagatagtgttcctcttgtagcaatcacaggacaagtccctcgtcgtatgattggtacagatgcgtttcaagagactccgattgttgaggtaacgcgttcgattacgaagcataactatcttgtgatggatgttgaagatatcccaaggattattgaagaggctttctttttagctacttctggtagacctggacctgttttggttgatgttcctaaagatattcaacaacagcttgcgattcctaattgggaacaggctatgagattacctggttatatgtctaggatgcctaaacctccggaagattctcatttggagcagattgttaggttgatttctgagtctaagaagcctgtgttgtatgttggtggtggttgtcttaattctagcgatgaattgggtaggtttgttgagcttacgggcatccctgttgcgagtacgttgatggggctgggatcttatccttgtgatgatgagttgtcgttacatatgcttggaatgcatgggactgtgtatgcaaattacgctgtggagcatagtgatttgttgttggcgtttggggtaaggtttgatgatcgtgtcacgggtaaacttgaggcttttgctagtagggctaagattgttcatattgatattgactcggctgagattgggaagaataagactcctcatgtgtctgtgtgtggtgatgttaagctggctttgcaagggatgaataaggttcttgagaaccgagcggaggagcttaaacttgattttggagtttggaggaatgagttgaacgtacagaaacagaagtttccgttgagctttaagacgtttggggaagctattcctccacagtatgcgattaaggtccttgatgagttgactgatggaaaagccataataagtactggtgtcgggcaacatcaaatgtgggcggcgcagttctacaattacaagaaaccaaggcagtggctatcatcaggaggccttggagctatgggatttggacttcctgctgcgattggagcgtctgttgctaaccctgatgcgatagttgtggatattgacggagatggaagttttataatgaatgtgcaagagctagccactattcgtgtagagaatcttccagtgaaggtacttttattaaacaaccagcatcttggcatggttatgcaatgggaagatcggttctacaaagctaaccgagctcacacatttctcggggacccggctcaggaggacgagatattcccgaacatgttgctgtttgcagcagcttgcgggattccagcggcgagggtgacaaagaaagcagatctccgagaagctattcagacaatgctggatacaccaggaccttacctgttggatgtgatttgtccgcaccaagaacatgtgttgccgatgatcccgaatggtggcactttcaacgatgtcataacggaaggagatggccggattaaatactgagagatgaaaccggtgattatcagaaccttttatggtctttgtatgcatatggtaaaaaaacttagtttgcaatttcctgtttgttttggtaatttgagtttcttttagttgttgatctgcctgctttttggtttacgtcagactactactgctgttgttgtttggtttcctttctttcattttataaataaataatccggttcggtttactccttgtgactggctcagtttggttattgcgaaatgcgaatggtaaattgagtaattgaaattcgttattagggttctaagctgttttaacagtcactgggttaatatctctcgaatcttgcatggaaaatgctcttaccattggtttttaattgaaatgtgctcatatgggccgtggtttccaaattaaataaaactacgatgtcatcgagaagtaaaatcaactgtgtccacattatcagttttgtgtatacgatgaaatagggtaattcaaaatctagcttgatatgccttttggttcattttaaccttctgtaaacattttttcagattttgaacaagtaaatccaaaaaaaaaaaaaaaaatctcaactcaacactaaattattttaatgtataaaagatgcttaaaacatttggcttaaaagaaagaagctaaaaacatagagaactcttgtaaattgaagtatgaaaatatactgaattgggtattatatgaatttttctgatttaggattcacatgatccaaaaaggaaatccagaagcactaatcagacattggaagtaggattaatcagtgatcagtaactattaaattcaattaaccgcggacatctacatttttgaattgaaaaaaaattggtaattactctttctttttctccatattgaccatcatactcattgt

SEQ ID NO: 300 - DNA, 20 bp, Artificial sequence
  LBFDAU  Locus 1 RB junction region
tataaataagcagtcagcat

SEQ ID NO: 301 - DNA, 20 bp, Artificial sequence
  LBFDAU Locus 1 LB junction region
tactcattgtaagacacaca

SEQ ID NO: 302 - DNA, 1600 bp, Artificial sequence; identical to SEQ ID NO: 237
  LBFDAU  Locus 1 flanking sequence up to and including the right border of the T-DNA

SEQ ID NO: 303 - DNA, 1677 bp, Artificial sequence; identical to SEQ ID NO: 238
  LBFDAU  Locus 1 flanking sequence up to and including the left border of the T-DNA

SEQ ID NO: 304 - DNA, 24 bp, Artificial sequence
  LBFDAU  Locus 1_Forward primer
gcggacatctacatttttgaattg

SEQ ID NO: 305 - DNA, 28 bp, Artificial sequence
  LBFDAU  Locus 1_Reverse primer
gctatttgacttcttcatctgtgtgtct

SEQ ID NO: 306 - DNA, 22 bp, Artificial sequence
  LBFDAU  locus 1_Probe
tttctccatattgaccatcata

SEQ ID NO: 307 - DNA, 39620 bp, Artificial sequence
  contig of insert and flanking sequences of LBFDAU T-DNA Locus 2
attttagatttagtcatatttttaacttaattattaattataataaatatttttagtgatttagatgataaattttcattgtcttgagaataataaaaaaaaaatctaaggataatatcatagttaaatttatatgatatttacttcagtaatattaaaatattatatacatttttattatatttggtttagtaatattaaatggattctattttaaatttcttatgacaatcaaaaccacttagtgtgataatttctgaaaaaaattggcaaaaaaatcaaaaatacttatcttattatttgtagtgatttttctctctctcatgttaaaattttgaatgtttaaagtctttattatctttaataaataattagattaaatttttaatatataattacccataatttaaaacaaatttcattaattttaaaatcatcattatctaaaaagattatatattatgttatccaaaaatattttacatcataatattttaaaataaatataaatttatgtatattgttttatgtatatatgaatgtttttaagtttattttacataatcaaatatattttacaaaaataatttttatcatatataaaatttaacatttaattaattattaaatatttcaaaagtatgaatataacttattctcatggtttttaattgataatatatctatttacaattttttgtaaaattattaaacccgcaagtatggacaaaacacctagtatatatatttggaacaaagaatacagacaaaacacctagtatatatatttggaacaaaaaatatacgtacatattttatatacatgaataacttatatatcacttagaaataggataatcaattgacattaaactctcttaaattatatattgtatagaagaactatagatatacgtataaaatatttataaaagataactacactatatatagaaacagataacgatacatccacgaaaattcttctggaaaagaaacagagtggtttcgcgtcagcacacctacgttgatcattggaaattggaatattgaaacacgcttcaaatcaacgactattaattaccaatacaccctggctttggggtgagagttgatcggttaattatccaatacatgccgttggttaattaggattatataaaaaatcgatcatctattagaatcgattacggttaaataggtataaaaatggagagaattgaatcagttataaatttgttttcagttaaaatatttctatgatcttcaatcgatttcggtattttatactcaacatggaaaaaatttcaaatgtatttcttctaaaagcaaaagaatctataaaaactatcattttatccaaaacaccaaaatagtcttttacaatcttttacagccttcacataaacgaaaacaaaagtgaacaatttctttttacagcctttacaccaaaaagactacgatgaactatgataaaatttcataatctaaaaacattaatgaggtaaagactctctcaaatgggatattcttcgaaaattttcataatcgaacgatatacttgaatttgcaactcatgaccgaaattgtcccaatccataatactctttgacaccctatcagatcccaacgttgtccctggtttcgaaaccaccatttcaaacatgaacatatcacaaaataaacatttagacaccaaatatctgctaagcgcttacgtaagctcagctgacgctacctagcgttagctaacgtcacgtgacgctacctagcgttacgtaacgtcagctgaggctagctagctgaattaacgccgaattaattcgggggatctggattttagtactggattttggttttaggaattagaaattttattgatagaagtattttacaaatacaaatacatactaagggtttcttatatgctcaacacatgagcgaaaccctataggaaccctaattcccttatctgggaactactcacacattattatggagaaactcgagcttgtcgatcactcggtcttagctcccttttgctttccatcggatggcttgatgtacttttgcacgtagaagtttccgaagaggaacaagagggagatcatgtagtagaagaggatcttgatgagccattgtggatatggagcgttggttttcatatcgtagtaagcttgcaccaagttgagcatgaactggaacatctggaattgggtgaggtatcttccccagaagaggtacttgttcttgagctttggggaagatctcaagcaagcagccaagaagtagtaagcgtacatcaacacgtgcactccagagttgagagcagcactccaataagcctctcctcctggagcgtggtgagcaatagcccaccagataagggagatagaagagtggtggtacacgtggaggaaagaaatctgtctggtggatctcttgaggatcatgatcacggtatccatgaactccacgtacttggacatgtagaagaggtaaacgaggatagccatctccttgtgctttgggttataagcgtttccccacaaggaatatctccaggtgatagcttggtaagcgatacccacgcacatgtaaagagacaaagcgaagcagaacaagttgtgcaccaacaccaaagcttgcaacaagaatggctcagaagctcttggcttgagatctctagccttgatccaaagcaatcctccgatcacgatggtcaagtaaacagacactcccaacacaattggagttggagaatcaacgagtggcaatcccttagtagttggggtatcagtcaactcaactccgaaagatcccaacaaagcgttcactccttgggaaacctttccatccaactctccgtagaacctctcaacaacttccatggtttcttctaaagctgaaagtgaaccattattacaacttaacactcaactcacaagaggagaagcaacaaagcttatgtaaggatttagtattaaggccaaaaaaacacagatcaaattcaattattgaagctttacttatcaagttatcatataaccaatgaagacggtaattcaaaagaaaaataaaagggtttgtagaataattgatacgtttacctttgccgattcagagacagtgaagcttaaacagtactggctatgaagaaattataatcgtgtaaaacttagtgagtgtgtatgaatgaaagtattgcaaaatcctcattatatagactacatgcataactagttgcatgtaaatttgtagttttcttcattattgcatcctccaagtggatgtcatggttttacacatggcttccatgcaaatcatttccaaaatatttttaaactttccacagggcatccatgcatgcacctcaaaacttgtgtgtggtaacattgttgtcttgaaaaattactaaaccttttgtccacgtgacgttcatgcacctcaaatcttgtgtggtaccattattatcctcaagaattattgaatgtttggtgtatatgccatccatgcagcattgcaacaattaaatctccaaaccttgtggtaccatattcactcactttaattctcctatagtagaaatattagcaaatatttacatttccagttgattagtatatgtatttagaagacaaaaataatttagaatcaattaatcaacttgcaaattgctaagtgttggcaaacgttagcataaaaggtgttataaatttagtaccaaatataaaaatttatcgcaaatcaaatacataacacacatagtaaaacaaaaacaaattacaagggtttagacgtttagtggcaatgtgtaaatttgctgcaggagtgacgctagctagcgttacgtaacgtcagctgagcctaggtagcgttagctaagctcacgtgacgctacgtaggcttacgtaacgtcagctgaggctacgtagcgttagctaacgtcacgtgacgctacgtaggcttacgtaatagttactaatcagtgatcaggcgcgccattaatttccaccttcacctacgatggggggcatcgcaccggtgagtaatattgtacggctaagagcgaatttggcctgtagacctcaattgcgagctttctaatttcaaactattcgggcctaacttttggtgtgatgatgctgactgtttcgacgttaattgatcctacactatgtaggtcatatccatcgttttaatttttggccaccattcaattctgtcttgcctttagggatgtgaatatgaacggccaaggtaagagaataaaaataatccaaattaaagcaagagaggccaagtaagataatccaaatgtacacttgtcattgccaaaattagtaaaatactcggcatattgtattcccacacattattaaaataccgtatatgtattggctgcatttgcatgaataatactacgtgtaagcccaaaagaacccacgtgtagcccatgcaaagttaacactcacgaccccattcctcagtctccactatataaacccaccatccccaatctcaccaaacccaccacacaactcacaactcactctcacaccttaaagaaccaatcaccaccaaaaaatttcacgatttggaatttgattcctgcgatcacaggtatgacaggttagattttgttttgtatagttgtatacatacttctttgtgatgttttgtttacttaatcgaatttttggagtgttttaaggtctctcgtttagaaatcgtggaaaatatcactgtgtgtgtgttcttatgattcacagtgtttatgggtttcatgttctttgttttatcattgaatgggaagaaatttcgttgggatacaaatttctcatgttcttactgatcgttattaggagtttggggaaaaaggaagagtttttttggttggttcgagtgattatgaggttatttctgtatttgatttatgagttaatggtcgttttaatgttgtagacatgggaaaaggatctgagggaagatctgctgctagagagatgactgctgaggctaacggagataagagaaagaccatcctcattgagggagtgttgtacgatgctaccaacttcaaacacccaggaggttccattattaacttcctcaccgagggagaagctggagttgatgctacccaagcttacagagagttccatcagagatccggaaaggctgataagtacctcaagtccctcccaaagttggatgcttctaaggtggagtctaggttctctgctaaggagcaggctagaagggacgctatgaccagggattacgctgctttcagagaggagttggttgctgagggatacttcgatccatctatcccacacatgatctacagagtggtggagattgtggctttgttcgctttgtctttctggttgatgtctaaggcttctccaacctctttggttttgggagtggtgatgaacggaatcgctcaaggaagatgcggatgggttatgcacgagatgggacacggatctttcactggagttatctggctcgatgataggatgtgcgagttcttctacggagttggatgtggaatgtctggacactactggaagaaccagcactctaagcaccacgctgctccaaacagattggagcacgatgtggatttgaacaccttgccactcgttgctttcaacgagagagttgtgaggaaggttaagccaggatctttgttggctttgtggctcagagttcaggcttatttgttcgctccagtgtcttgcttgttgatcggattgggatggaccttgtacttgcacccaagatatatgctcaggaccaagagacacatggagtttgtgtggatcttcgctagatatatcggatggttctccttgatgggagctttgggatattctcctggaacttctgtgggaatgtacctctgctctttcggacttggatgcatctacatcttcctccaattcgctgtgtctcacacccacttgccagttaccaacccagaggatcaattgcactggcttgagtacgctgctgatcacaccgtgaacatctctaccaagtcttggttggttacctggtggatgtctaacctcaacttccaaatcgagcaccacttgttcccaaccgctccacaattcaggttcaaggagatctctccaagagttgaggctctcttcaagagacacaacctcccttactacgatttgccatacacctctgctgtttctactaccttcgctaacctctactctgttggacactctgttggagctgataccaagaagcaggattgactgctttaatgagatatgcgagacgcctatgatcgcatgatatttgctttcaattctgttgtgcacgttgtaaaaaacctgagcatgtgtagctcagatccttaccgccggtttcggttcattctaatgaatatatcacccgttactatcgtatttttatgaataatattctccgttcaatttactgattgtctacgtaggctcagctgagcttacctaaggctacgtaggctcacgtgacgttacgtaaggctacgtagcgtcacgtgagcttacctaactctagctagcctcacgtgaccttagctaacactaggtagcgtcagctcgacggcccggactgtatccaacttctgatctttgaatctctctgttccaacatgttctgaaggagttctaagacttttcagaaagcttgtaacatgctttgtagactttctttgaattactcttgcaaactctgattgaacctacgtgaaaactgctccagaagttctaaccaaattccgtcttgggaaggcccaaaatttattgagtacttcagtttcatggacgtgtcttcaaagatttataacttgaaatcccatcatttttaagagaagttctgttccgcaatgtcttagatctcattgaaatctacaactcttgtgtcagaagttcttccagaatcaacttgcatcatggtgaaaatctggccagaagttctgaacttgtcatatttcttaacagttagaaaaatttctaagtgtttagaattttgacttttccaaagcaaacttgacttttgactttcttaataaaacaaacttcatattctaacatgtcttgatgaaatgtgattcttgaaatttgatgttgatgcaaaagtcaaagtttgacttttcagtgtgcaattgaccattttgctcttgtgccaattccaaacctaaattgatgtatcagtgctgcaaacttgatgtcatggaagatcttatgagaaaattcttgaagactgagaggaaaaattttgtagtacaacacaaagaatcctgtttttcatagtcggactagacacattaacataaaacaccacttcattcgaagagtgattgaagaaggaaatgtgcagttacctttctgcagttcataagagcaacttacagacacttttactaaaatactacaaagaggaagattttaacaacttagagaagtaatgggagttaaagagcaacacattaagggggagtgttaaaattaatgtgttgtaaccaccactacctttagtaagtattataagaaaattgtaatcatcacattataattattgtccttatttaaaattatgataaagttgtatcattaagattgagaaaaccaaatagtcctcgtcttgatttttgaattattgttttctatgttacttttcttcaagcctatataaaaactttgtaatgctaaattgtatgctggaaaaaaatgtgtaatgaattgaatagaaattatggtatttcaaagtccaaaatccatcaatagaaatttagtacaaaacgtaactcaaaaatattctcttattttaaattttacaacaatataaaaatattctcttattttaaattttacaataatataatttatcacctgtcacctttagaataccaccaacaatattaatacttagatattttattcttaataattttgagatctctcaatatatctgatatttattttatatttgtgtcatattttcttatgttttagagttaacccttatatcttggtcaaactagtaattcaatatatgagtttgtgaaggacacattgacatcttgaaacattggttttaaccttgttggaatgttaaaggtaataaaacattcagaattatgaccatctattaatatacttcctttgtcttttaaaaaagtgtgcatgaaaatgctctatggtaagctagagtgtcttgctggcctgtgtatatcaattccatttccagatggtagaaactgccactacgaataattagtcataagacacgtatgttaacacacgtccccttgcatgttttttgccatatattccgtctctttctttttcttcacgtataaaacaatgaactaattaatagagcgatcaagctgaacagttctttgctttcgaagttgccgcaacctaaacaggtttttccttcttctttcttcttattaactacgaccttgtcctttgcctatgtaaaattactaggttttcatcagttacactgattaagttcgttatagtggaagataaaatgccctcaaagcattttgcaggatatctttgatttttcaaagatatggaactgtagagtttgatagtgttcttgaatgtggttgcatgaagtttttttggtctgcatgttattttttcctcgaaatatgttttgagtccaacaagtgattcacttgggattcagaaagttgttttctcaatatgtaacagtttttttctatggagaaaaatcatagggaccgttggttttggcttctttaattttgagctcagattaaacccattttacccggtgttcttggcagaattgaaaacagtacgtagtaccgcgcctaccatgtgtgttgagaccgagaacaacgatggaatccctactgtggagatcgctttcgatggagagagagaaagagctgaggctaacgtgaagttgtctgctgagaagatggaacctgctgctttggctaagaccttcgctagaagatacgtggttatcgagggagttgagtacgatgtgaccgatttcaaacatcctggaggaaccgtgattttctacgctctctctaacactggagctgatgctactgaggctttcaaggagttccaccacagatctagaaaggctaggaaggctttggctgctttgccttctagacctgctaagaccgctaaagtggatgatgctgagatgctccaggatttcgctaagtggagaaaggagttggagagggacggattcttcaagccttctcctgctcatgttgcttacagattcgctgagttggctgctatgtacgctttgggaacctacttgatgtacgctagatacgttgtgtcctctgtgttggtttacgcttgcttcttcggagctagatgtggatgggttcaacacgagggaggacactcttctttgaccggaaacatctggtgggataagagaatccaagctttcactgctggattcggattggctggatctggagatatgtggaactccatgcacaacaagcaccacgctactcctcaaaaagtgaggcacgatatggatttggataccactcctgctgttgctttcttcaacaccgctgtggaggataatagacctaggggattctctaagtactggctcagattgcaagcttggaccttcattcctgtgacttctggattggtgttgctcttctggatgttcttcctccacccttctaaggctttgaagggaggaaagtacgaggagcttgtgtggatgttggctgctcacgtgattagaacctggaccattaaggctgttactggattcaccgctatgcaatcctacggactcttcttggctacttcttgggtttccggatgctacttgttcgctcacttctctacttctcacacccacttggatgttgttcctgctgatgagcacttgtcttgggttaggtacgctgtggatcacaccattgatatcgatccttctcagggatgggttaactggttgatgggatacttgaactgccaagtgattcaccacctcttcccttctatgcctcaattcagacaacctgaggtgtccagaagattcgttgctttcgctaagaagtggaacctcaactacaaggtgatgacttatgctggagcttggaaggctactttgggaaacctcgataatgtgggaaagcactactacgtgcacggacaacactctggaaagaccgcttgattaatgaaggccgcctcgaccgtaccccctgcagatagactatactatgttttagcctgcctgctggctagctactatgttatgttatgttgtaaaataaacacctgctaaggtatatctatctatattttagcatggctttctcaataaattgtctttccttatcgtttactatcttatacctaataatgaaataataatatcacatatgaggaacggggcaggtttaggcatatatatacgagtgtagggcggagtggggctacgtagcgtcacgtgacgttacctaagcctaggtagcctcagctgacgttacgtaacgctaggtaggctcagctgacacgggcaggacatagggactactacaagcatagtatgcttcagacaaagagctaggaaagaactcttgatggaggttaagagaaaaaagtgctagaggggcatagtaatcaaacttgtcaaaaccgtcatcatgatgagggatgacataatataaaaagttgactaaggtcttggtagtactctttgattagtattatatattggtgagaacatgagtcaagaggagacaagaaaccgaggaaccatagtttagcaacaagatggaagttgcaaagttgagctagccgctcgattagttacatctcctaagcagtactacaaggaatggtctctatactttcatgtttagcacatggtagtgcggattgacaagttagaaacagtgcttaggagacaaagagtcagtaaaggtattgaaagagtgaagttgatgctcgacaggtcaggagaagtccctccgccagatggtgactaccaaggggttggtatcagctgagacccaaataagattcttcggttgaaccagtggttcgaccgagactcttagggtgggatttcactgtaagatttgtgcattttgttgaatataaattgacaattttttttatttaattatagattatttagaatgaattacatatttagtttctaacaaggatagcaatggatgggtatgggtacaggttaaacatatctattacccacccatctagtcgtcgggttttacacgtacccacccgtttacataaaccagaccggaattttaaaccgtacccgtccgttagcgggtttcagatttacccgtttaatcgggtaaaacctgattactaaatatatattttttatttgataaacaaaacaaaaatgttaatattttcatattggatgcaattttaagaaacacatattcataaatttccatatttgtaggaaaataaaaagaaaaatatattcaagaacacaaatttcaccgacatgacttttattacagagttggaattagatctaacaattgaaaaattaaaattaagatagaatatgttgaggaacatgacatagtataatgctgggttacccgtcgggtaggtatcgaggcggatactactaaatccatcccactcgctatccgataatcactggtttcgggtatacccattcccgtcaacaggcctttttaaccggataatttcaacttatagtgaatgaattttgaataaatagttagaataccaaaatcctggattgcatttgcaatcaaattttgtgaaccgttaaattttgcatgtacttgggatagatataatagaaccgaattttcattagtttaatttataacttactttgttcaaagaaaaaaaatatctatccaatttacttataataaaaaataatctatccaagttacttattataatcaacttgtaaaaaggtaagaatacaaatgtggtagcgtacgtgtgattatatgtgacgaaatgttatatctaacaaaagtccaaattcccatggtaaaaaaaatcaaaatgcatggcaggctgtttgtaaccttggaataagatgttggccaattctggagccgccacgtacgcaagactcagggccacgttctcttcatgcaaggatagtagaacaccactccacccacctcctatattagacctttgcccaaccctccccaactttcccatcccatccacaaagaaaccgacatttttatcataaatctggtgcttaaacactctggtgagttctagtacttctgctatgatcgatctcattaccatttcttaaatttctctccctaaatattccgagttcttgatttttgataacttcaggttttctctttttgataaatctggtctttccattttttttttttgtggttaatttagtttcctatgttcttcgattgtattatgcatgatctgtgtttggattctgttagattatgtattggtgaatatgtatgtgtttttgcatgtctggttttggtcttaaaaatgttcaaatctgatgatttgattgaagcttttttagtgttggtttgattcttctcaaaactactgttaatttactatcatgttttccaactttgattcatgatgacacttttgttctgctttgttataaaattttggttggtttgattttgtaattatagtgtaattttgttaggaatgaacatgttttaatactctgttttcgatttgtcacacattcgaattattaatcgataatttaactgaaaattcatggttctagatcttgttgtcatcagattatttgtttcgataattcatcaaatatgtagtccttttgctgatttgcgactgtttcattttttctcaaaattgttttttgttaagtttatctaacagttatcgttgtcaaaagtctctttcattttgcaaaatcttctttttttttttgtttgtaactttgttttttaagctacacatttagtctgtaaaatagcatcgaggaacagttgtcttagtagacttgcatgttcttgtaacttctatttgtttcagtttgttgatgactgctttgattttgtaggtcaaaggcgcaccctaccatggatgcttataacgctgctatggataagattggagctgctatcatcgattggagtgatccagatggaaagttcagagctgatagggaggattggtggttgtgcgatttcagatccgctatcaccattgctctcatctacatcgctttcgtgatcttgggatctgctgtgatgcaatctctcccagctatggacccataccctatcaagttcctctacaacgtgtctcaaatcttcctctgcgcttacatgactgttgaggctggattcctcgcttataggaacggatacaccgttatgccatgcaaccacttcaacgtgaacgatccaccagttgctaacttgctctggctcttctacatctccaaagtgtgggatttctgggataccatcttcattgtgctcggaaagaagtggagacaactctctttcttgcacgtgtaccaccacaccaccatcttcctcttctactggttgaacgctaacgtgctctacgatggagatatcttcttgaccatcctcctcaacggattcattcacaccgtgatgtacacctactacttcatctgcatgcacaccaaggattctaagaccggaaagtctttgccaatctggtggaagtcatctttgaccgctttccaactcttgcaattcaccatcatgatgtcccaagctacctacttggttttccacggatgcgataaggtttccctcagaatcaccatcgtgtacttcgtgtacattctctcccttttcttcctcttcgctcagttcttcgtgcaatcctacatggctccaaagaagaagaagtccgcttgatgttaatgaaggccgcagatatcagatctggtcgacctagaggatccccggccgcaaagataataacaaaagcctactatataacgtacatgcaagtattgtatgatattaatgtttttacgtacgtgtaaacaaaaataattacgtttgtaacgtatggtgatgatgtggtgcactaggtgtaggccttgtattaataaaaagaagtttgttctatatagagtggtttagtacgacgatttatttactagtcggattggaatagagaaccgaattcttcaatccttgcttttgatcaagaattgaaaccgaatcaaatgtaaaagttgatatatttgaaaaacgtattgagcttatgaaaatgctaatactctcatctgtatggaaaagtgactttaaaaccgaacttaaaagtgacaaaaggggaatatcgcatcaaaccgaatgaaaccgatctacgtaggctcagctgagcttagctaagcctacctagcctcacgtgagattatgtaaggctaggtagcgtcacgtgacgttacctaacactagctagcgtcagctgagcttagctaaccctacgtagcctcacgtgagcttacctaacgctacgtagcctcacgtgactaaggatgacctacccattcttgagacaaatgttacattttagtatcagagtaaaatgtgtacctataactcaaattcgattgacatgtatccattcaacataaaattaaaccagcctgcacctgcatccacatttcaagtattttcaaaccgttcggctcctatccaccgggtgtaacaagacggattccgaatttggaagattttgactcaaattcccaatttatattgaccgtgactaaatcaactttaacttctataattctgattaagctcccaatttatattcccaacggcactacctccaaaatttatagactctcatccccttttaaaccaacttagtaaacgttttttttttaattttatgaagttaagtttttaccttgtttttaaaaagaatcgttcataagatgccatgccagaacattagctacacgttacacatagcatgcagccgcggagaattgtttttcttcgccacttgtcactcccttcaaacacctaagagcttctctctcacagcacacacatacaatcacatgcgtgcatgcattattacacgtgatcgccatgcaaatctcctttatagcctataaattaactcatcggcttcactctttactcaaaccaaaactcatcaatacaaacaagattaaaaacatttcacgatttggaatttgattcctgcgatcacaggtatgacaggttagattttgttttgtatagttgtatacatacttctttgtgatgttttgtttacttaatcgaatttttggagtgttttaaggtctctcgtttagaaatcgtggaaaatatcactgtgtgtgtgttcttatgattcacagtgtttatgggtttcatgttctttgttttatcattgaatgggaagaaatttcgttgggatacaaatttctcatgttcttactgatcgttattaggagtttggggaaaaaggaagagtttttttggttggttcgagtgattatgaggttatttctgtatttgatttatgagttaatggtcgttttaatgttgtagaccgccatggctattttgaaccctgaggctgattctgctgctaacctcgctactgattctgaggctaagcaaagacaattggctgaggctggatacactcacgttgagggtgctcctgctcctttgcctttggagttgcctcacttctctctcagagatctcagagctgctattcctaagcactgcttcgagagatctttcgtgacctccacctactacatgatcaagaacgtgttgacttgcgctgctttgttctacgctgctaccttcattgatagagctggagctgctgcttatgttttgtggcctgtgtactggttcttccagggatcttacttgactggagtgtgggttatcgctcacgagtgtggacaccaggcttattgctcttctgaggtggtgaacaacttgattggactcgtgttgcactctgctttgttggtgccttaccactcttggagaatctctcacagaaagcaccactccaacactggatcttgcgagaacgatgaggttttcgttcctgtgaccagatctgtgttggcttcttcttggaacgagaccttggaggattctcctctctaccaactctaccgtatcgtgtacatgttggttgttggatggatgcctggatacctcttcttcaacgctactggacctactaagtactggggaaagtctaggtctcacttcaacccttactccgctatctatgctgatagggagaggtggatgatcgtgctctccgatattttcttggtggctatgttggctgttttggctgctttggtgcacactttctccttcaacacgatggtgaagttctacgtggtgccttacttcattgtgaacgcttacttggtgttgattacctacctccaacacaccgatacctacatccctcacttcagagagggagagtggaattggttgagaggagctttgtgcactgtggatagatcatttggtccattcctcgattctgtggtgcatagaatcgtggatacccacgtttgccaccatatcttctccaagatgcctttctatcactgcgaggaggctaccaacgctattaagcctctcctcggaaagttctacttgaaggatactactcctgttcctgttgctctctggagatcttacacccactgcaagttcgttgaggatgatggaaaggtggtgttctacaagaacaagttatagttaatgaataattgattggttcgagtattatggcattgggaaaactgtttttcttgtaccatttgttgtgcttgtaatttactgtgttttttattcggttttcgctatcgaactgtgaaatggaaatggatggagaagagttaatgaatgatatggtccttttgttcattctcaaattaatattatttgttttttctcttatttgttgtgtgttgaatttgaaattataagagatatgcaaacattttgttttgagtaaaaatgtgtcaaatcgtggcctctaatgaccgaagttaatatgaggagtaaaacacttgtagttgtaccattatgcttattcactaggcaacaaatatattttcagacctagaaaagctgcaaatgttactgaatacaagtatgtcctcttgtgttttagacatttatgaactttcctttatgtaattttccagaatccttgtcagattctaatcattgctttataattatagttatactcatggatttgtagttgagtatgaaaatattttttaatgcattttatgacttgccaattgattgacaacatgcatcaatctagctagcctcagctgacgttacgtaacgctaggtagcgtcacgtgacgttagctaacgctaggtagcgtcagctgagcttacgtaagcgcacagatgaatactagctgttgttcacagttctagtgtctcctcattacgtgaattcaagctacgatcactatctcaactcctacataaacatcagaatgctacaaaactatgcacaaaaacaaaagctacatctaatacgtgaatcaattactctcatcacaagaaagaagatttcaatcaccgtcgagaaggaggattcagttaattgaatcaaagttccgatcaaactcgaagactggtgagcacgaggacgacgaagaagagtgtctcgaagatacaacaagcaagaaatctactgagtgacctcctgaagttattggcgcgattgagagaatcaatccgaattaatttcggggaaaaagataaattagatactaagcgatgggcttgggctgggctaagaaacaggtggcaattgggctggaggaccccgcgattcatagcttccgatagcccaaaaaaaaacggataacatatttatcgggtatttgaatttcagtgaaataagatattttctttttgttaggaaaattttagaaaataatggaaattaaatagcgattatgttacaagatacgatcagcatcgggcagtgcaaaatgctatagcttcccaagatttgatccttttgggttatctcctaatgacaattagtttaggattttgaaacttatattaatactattatccgacaacacttgtttcagcttcttattttaacattttttgtttttttctattcttcttcccatcagcattttctttttaaaaaattgaatactttaactttttaaaaatttcacaatgatcagatgatattatggaagatctcaagagttaaatgtatccatcttggggcattaaaaccggtgtacgggatgataaatacagactttatatcatatgatagctcagtaattcatatttatcacgttgctaaaaaaattataaggtactagtagtcaacaaaatcaattaaagagaaagaaagaaacgcatgtgaagagagtttacaactggaaaagtaaaataaaaattaacgcatgttgaatgctgacatgtcagtatgtccatgaatccacgtatcaagcgccattcatcgatcgtcttcctctttctaaatgaaaacaacttcacacatcacaacaaacaatacacacaagaccccctctctctcgttgtctctctgccagcgaccaaatcgaagcttgagaagaacaagaaggggtcaaaccatggcttctacatctgctgctcaagacgctgctccttacgagttcccttctctcactgagatcaagagggctcttccttctgagtgtttcgaggcttctgttcctctttctctctactacaccgctagatctcttgctcttgctggatctctcgctgttgctctctcttacgctagagctttgcctcttgttcaggctaacgctcttcttgatgctactctctgcactggatacgttcttctccagggaatcgttttctggggattcttcaccgttggtcacgattgtggacacggagctttctctagatctcacgtgctcaacttctctgttggaaccctcatgcactctatcatccttacccctttcgagtcttggaagctctctcacagacaccaccacaagaacaccggaaacatcgataaggacgagatcttctaccctcaaagagaggctgattctcaccctgtttctagacaccttgtgatgtctcttggatctgcttggttcgcttaccttttcgctggattccctcctagaaccatgaaccacttcaacccttgggaggctatgtatgttagaagagtggctgctgtgatcatctctctcggagttcttttcgctttcgctggactctactcttacctcaccttcgttcttggattcaccactatggctatctactacttcggacctctcttcatcttcgctaccatgcttgttgttaccactttcctccaccacaacgatgaggagacaccttggtacgctgattctgagtggacttacgtgaagggaaacctctcttctgtggacagatcttacggtgctctcatcgacaaccttagccacaacatcggaactcaccagatccaccacctcttccctatcatccctcactacaagctcaacgatgctactgctgctttcgctaaggctttccctgagcttgttaggaaaaacgctgctcctatcatcccaactttcttcaggatggctgctatgtacgctaagtacggagttgttgacactgatgctaagaccttcactctcaaggaggctaaggctgctgctaagactaagtcatcttgatgattaatgaataattgattgtacatactatattttttgtttaccttgtgttagtttaatgttcagtgtcctctctttattgtggcacgtctctttgttgtatgttgtgtctatacaaagttgaaataatggaaagaaaaggaagagtgtaatttgttttgttttaagtgtttataaatatatatatataggtcatttagatagttctaggtttctataaaactctctctctggaagtagaatctgtttttgagaggatccagttgcctactaatctcccccaaaacccttcaagcttaaccttcctcttcacaacaacagaggaaacacatctcttgagctctgagttctcttctttgagcatgtctatcgctaaactcatctgccttatagcttccctcttctcttcatctctctctctcaccatttcgctgtaaaacttattctcctccctcagcctctctatctcttccttcagcatctcacaattcccaccataatcgactgaggatgattcaccgtcatcaacttcagactcagcgttgtagtcgtcatgagtctcacaagccttggaccaagaagactcatcatcgcaagttgatgatttatcatgatgcttctctgagccgtgtttgctacgtagcgtcacgtgacgttacctaagcctaggtagcctcagctgacgttacgtaacgctaggtaggctcagctgactgcagcaaatttacacattgccactaaacgtctaaacccttgtaatttgtttttgttttactatgtgtgttatgtatttgatttgcgataaatttttatatttggtactaaatttataacaccttttatgctaacgtttgccaacacttagcaatttgcaagttgattaattgattctaaattatttttgtcttctaaatacatatactaatcaactggaaatgtaaatatttgctaatatttctactataggagaattaaagtgagtgaatatggtaccacaaggtttggagatttaattgttgcaatgctgcatggatggcatatacaccaaacattcaataattcttgaggataataatggtaccacacaagatttgaggtgcatgaacgtcacgtggacaaaaggtttagtaatttttcaagacaacaatgttaccacacacaagttttgaggtgcatgcatggatgccctgtggaaagtttaaaaatattttggaaatgatttgcatggaagccatgtgtaaaaccatgacatccacttggaggatgcaataatgaagaaaactacaaatttacatgcaactagttatgcatgtagtctatataatgaggattttgcaatactttcattcatacacactcactaagttttacacgattataatttcttcatagccagtactgtttaagcttcactgtctctgaatcggcaaaggtaaacgtatcaattattctacaaacccttttatttttcttttgaattaccgtcttcattggttatatgataacttgataagtaaagcttcaataattgaatttgatctgtgtttttttggccttaatactaaatccttacataagctttgttgcttctcctcttgtgagttgagtgttaagttgtaataatggttcactttcagctttagaagaaacgcgccttccatggctacaaaggaggcttacgttttcccaactctcaccgagatcaagagatctctcccaaaggattgcttcgaggcttctgtgcctttgtctctctactacactgtgagatgcttggttattgctgtggctttgaccttcggattgaactacgctagagctttgccagaggttgagtctttctgggctttggatgctgctttgtgcactggatatatcctcctccagggaattgtgttctggggattcttcactgttggacacgatgctggacacggagctttctctagataccacctcttgaacttcgttgtgggaaccttcatgcactctctcatcttgaccccattcgagtcttggaagttgacccacagacaccaccacaagaacaccggaaacatcgatagagatgaggtgttctacccacagagaaaggctgatgatcacccattgtccaggaacttgatcttggctttgggagctgcttggcttgcttatttggtggagggattcccaccaagaaaggtgaaccacttcaacccattcgagccactttttgtgagacaagtgtccgctgtggttatctctttgctcgctcacttcttcgttgctggactctctatctacttgtctctccagttgggacttaagaccatggctatctactactacggaccagttttcgtgttcggatctatgttggtgattaccaccttcttgcaccacaacgatgaggagactccatggtatgctgattctgagtggacttacgtgaagggaaacttgtcctctgtggatagatcttacggtgctctcatcgataacctctcccacaacatcggaactcaccagatccaccacctcttcccaattatcccacactacaagctcaagaaggctactgctgctttccaccaagctttcccagagcttgtgagaaagtccgatgagccaatcatcaaggctttcttcagagtgggaaggttgtatgctaactacggagtggttgatcaagaggctaagctcttcactttgaaggaggctaaggctgctactgaagctgctgctaagaccaagtctacctgattaatgaatcgacaagctcgagtttctccataataatgtgtgagtagttcccagataagggaattagggttcctatagggtttcgctcatgtgttgagcatataagaaacccttagtatgtatttgtatttgtaaaatacttctatcaataaaatttctaattcctaaaaccaaaatccagtactaaaatccagatcccccgaattaattcggcgttaattcagctacgtaggctcagctgagcttacctaaggctacgtaggctcacgtgacgttacgtaaggctacgtagcgtcacgtgagcttacctaactctagctagcctcacgtgaccttagctaacactaggtagcgtcagcacagatgaatactagctgttgttcacagttctagtgtctcctcattacgtgaattcaagctacgatcactatctcaactcctacataaacatcagaatgctacaaaactatgcacaaaaacaaaagctacatctaatacgtgaatcaattactctcatcacaagaaagaagatttcaatcaccgtcgagaaggaggattcagttaattgaatcaaagttccgatcaaactcgaagactggtgagcacgaggacgacgaagaagagtgtctcgaagatacaacaagcaagaaatctactgagtgacctcctgaagttattggcgcgattgagagaatcaatccgaattaatttcggggaaaaagataaattagatactaagcgatgggcttgggctgggctaagaaacaggtggcaattgggctggaggaccccgcgattcatagcttccgatagcccaaaaaaaaacggataacatatttatcgggtatttgaatttcagtgaaataagatattttctttttgttaggaaaattttagaaaataatggaaattaaatagcgattatgttacaagatacgatcagcatcgggcagtgcaaaatgctatagcttcccaagatttgatccttttgggttatctcctaatgacaattagtttaggattttgaaacttatattaatactattatccgacaacacttgtttcagcttcttattttaacattttttgtttttttctattcttcttcccatcagcattttctttttaaaaaattgaatactttaactttttaaaaatttcacaatgatcagatgatattatggaagatctcaagagttaaatgtatccatcttggggcattaaaaccggtgtacgggatgataaatacagactttatatcatatgatagctcagtaattcatatttatcacgttgctaaaaaaattataaggtactagtagtcaacaaaatcaattaaagagaaagaaagaaacgcatgtgaagagagtttacaactggaaaagtaaaataaaaattaacgcatgttgaatgctgacatgtcagtatgtccatgaatccacgtatcaagcgccattcatcgatcgtcttcctctttctaaatgaaaacaacttcacacatcacaacaaacaatacacacaagaccccctctctctcgttgtctctctgccagcgaccaaatcgaagcttgagaagaacaagaaggggtcaaaccatgggaaaaggatctgagggaagatctgctgctagagagatgactgctgaggctaacggagataagagaaagaccatcctcattgagggagtgttgtacgatgctaccaacttcaaacacccaggaggttccattattaacttcctcaccgagggagaagctggagttgatgctacccaagcttacagagagttccatcagagatccggaaaggctgataagtacctcaagtccctcccaaagttggatgcttctaaggtggagtctaggttctctgctaaggagcaggctagaagggacgctatgaccagggattacgctgctttcagagaggagttggttgctgagggatacttcgatccatctatcccacacatgatctacagagtggtggagattgtggctttgttcgctttgtctttctggttgatgtctaaggcttctccaacctctttggttttgggagtggtgatgaacggaatcgctcaaggaagatgcggatgggttatgcacgagatgggacacggatctttcactggagttatctggctcgatgataggatgtgcgagttcttctacggagttggatgtggaatgtctggacactactggaagaaccagcactctaagcaccacgctgctccaaacagattggagcacgatgtggatttgaacaccttgccactcgttgctttcaacgagagagttgtgaggaaggttaagccaggatctttgttggctttgtggctcagagttcaggcttatttgttcgctccagtgtcttgcttgttgatcggattgggatggaccttgtacttgcacccaagatatatgctcaggaccaagagacacatggagtttgtgtggatcttcgctagatatatcggatggttctccttgatgggagctttgggatattctcctggaacttctgtgggaatgtacctctgctctttcggacttggatgcatctacatcttcctccaattcgctgtgtctcacacccacttgccagttaccaacccagaggatcaattgcactggcttgagtacgctgctgatcacaccgtgaacatctctaccaagtcttggttggttacctggtggatgtctaacctcaacttccaaatcgagcaccacttgttcccaaccgctccacaattcaggttcaaggagatctctccaagagttgaggctctcttcaagagacacaacctcccttactacgatttgccatacacctctgctgtttctactaccttcgctaacctctactctgttggacactctgttggagctgataccaagaagcaggattgatgattaatgaataattgattgtacatactatattttttgtttaccttgtgttagtttaatgttcagtgtcctctctttattgtggcacgtctctttgttgtatgttgtgtctatacaaagttgaaataatggaaagaaaaggaagagtgtaatttgttttgttttaagtgtttataaatatatatatataggtcatttagatagttctaggtttctataaaactctctctctggaagtagaatctgtttttgagaggatccagttgcctactaatctcccccaaaacccttcaagcttaaccttcctcttcacaacaacagaggaaacacatctcttgagctctgagttctcttctttgagcatgtctatcgctaaactcatctgccttatagcttccctcttctcttcatctctctctctcaccatttcgctgtaaaacttattctcctccctcagcctctctatctcttccttcagcatctcacaattcccaccataatcgactgaggatgattcaccgtcatcaacttcagactcagcgttgtagtcgtcatgagtctcacaagccttggaccaagaagactcatcatcgcaagttgatgatttatcatgatgcttctctgagccgtgtttgctacctagagtcagctgagcttagctaacgctagctagtgtcagctgacgttacgtaaggctaactagcgtcacgtgaccttacgtaacgctacgtaggctcagctgagcttagctaaccctagctagtgtcacgtgagcttacgctactatagaaaatgtgttatatcgacatgaccagacaaaggggcaacagttaacaaaacaattaattctttcatttgagattaaggaaggtaaggtactaaaaagattaaaaaaaatgagcttatctctttgtttctgtaataataatataagtgtgataaacttttaatataataattgtaattaggttttctacagatgagcaccactcagagacaagataagaagaaaacaattttgttaaacatgattatagaaacttttagttaagtcttgaagtatcaatataacaaaaaaaagtacacacgactatgacaataaacccactaccgtcaggttatcatttcgatgaaatgttttgatatcattaaatataacagtcacaaaaaatcatctaattataacaatataacttatacatatatttaactaaaaacttagagtttttgtaatgattctaattgatgattagagtttatagaaatacaattaaataaaaaatataattttaaaaaaacatagtaaagtcaatgagatcctctctgacctcagtgatcatttagtcatgtatgtacaacaatcattgttcatcacatgactgtaaaataaataaggataaacttgggaatatatataatatattgtattaaataaaaaagggaaatacaaatatcaattttagattcccgagttgacacaactcaccatgcacgctgccacctcagctcccagctctcgtcacatgtctcatgtcagttaggtctttggtttttagtctttgacacaactcgccatgcatgttgccacgtgagctcgttcctcttcccatgatctcaccactgggcatgcatgctgccacctcagctggcacctcttctctatatgtccctagaggccatgcacagtgccacctcagcactcctctcagaacccatacgtacctgccaatcggcttctctccataaatatctatttaaattataactaattatttcatatacttaattgatgacgtggatgcattgccatcgttgtttaataattgttaattacgacatgataaataaaatgaaagtaaaaagtacgaaagattttccatttgttgttgtataaatagagaagtgagtgatgcataatgcatgaatgcatgaccgcgccaccatgactgttggatacgacgaggagatcccattcgagcaagttagggctcataacaagccagacgacgcttggtgtgctattcacggacacgtgtacgacgttaccaagttcgcttcagttcacccaggaggagatattatcttgctcgctgctggaaaggaagctactgtcctctacgagacctaccatgttagaggagtgtctgacgctgtgctcagaaagtacagaataggaaagttgccagacggacaaggaggagctaacgagaaggagaagagaaccttgtctggattgtcctctgcttcttactacacctggaactccgatttctacagagtgatgagggagagagttgtggctagattgaaggagagaggaaaggctagaagaggaggatacgaactctggatcaaggctttcttgctccttgttggattctggtcctctctttactggatgtgcaccctcgatccatctttcggagctatcttggctgctatgtctttgggagtgttcgctgcttttgttggaacctgcatccaacacgatggaaaccacggagctttcgctcaatctagatgggttaacaaggtggcaggatggactttggatatgatcggagcttctggaatgacttgggagttccaacacgtgttgggacaccacccatacactaacttgatcgaggaggagaacggattgcaaaaggtgtccggaaagaagatggataccaagttggctgatcaagagtctgatccagatgtgttctccacctacccaatgatgagattgcacccttggcaccagaagaggtggtatcacaggttccagcacatctacggacctttcatcttcggattcatgaccatcaacaaggtggtgactcaagatgttggagtggtgttgagaaagagactcttccaaatcgatgctgagtgcagatatgcttccccaatgtacgttgctaggttctggattatgaaggctttgaccgtgttgtatatggttgctttgccttgttatatgcaaggaccttggcacggattgaaactcttcgctatcgctcacttcacttgcggagaggttttggctaccatgttcatcgtgaaccacattatcgagggagtgtcttacgcttctaaggatgctgttaagggaactatggctccaccaaagactatgcacggagtgaccccaatgaacaacactagaaaggaggttgaggctgaggcttctaagtctggagctgtggttaagtctgtgccattggatgattgggctgctgttcagtgccaaacctctgtgaactggtctgttggatcttggttttggaaccacttctctggaggactcaaccaccaaatcgagcaccacctcttcccaggattgtctcacgagacctactaccacatccaagacgtggttcaatctacctgtgctgagtacggagttccataccaacacgagccatctttgtggactgcttactggaagatgctcgaacaccttagacaattgggaaacgaggagactcacgagtcatggcagagagctgcttgattaatgaactaagactcccaaaaccaccttccctgtgacagttaaaccctgcttatacctttcctcctaataatgttcatctgtcacacaaactaaaataaataaaatgggagcaataaataaaatgggagctcatatatttacaccatttacactgtctattattcaccatgccaattattacttcataattttaaaattatgtcatttttaaaaattgcttaatgatggaaaggattattataagttaaaagtataacatagataaactaaccacaaaacaaatcaatataaactaacttactctcccatctaatttttatttaaatttctttacacttctcttccatttctatttctacaacattatttaacatttttattgtatttttcttactttctaactctattcatttcaaaaatcaatatatgtttatcaccacctctctaaaaaaaactttacaatcattggtccagaaaagttaaatcacgagatggtcattttagcattaaaacaacgattcttgtatcactatttttcagcatgtagtccattctcttcaaacaaagacagcggctatataatcgttgtgttatattcagtctaaaacaactagctagcctcagctgacgttacgtaacgctaggtagcgtcacgtgacgttagctaacgctaggtagcgtcagctgagcttacgtaagcgccacgggcaggacatagggactactacaagcatagtatgcttcagacaaagagctaggaaagaactcttgatggaggttaagagaaaaaagtgctagaggggcatagtaatcaaacttgtcaaaaccgtcatcatgatgagggatgacataatataaaaagttgactaaggtcttggtagtactctttgattagtattatatattggtgagaacatgagtcaagaggagacaagaaaccgaggaaccatagtttagcaacaagatggaagttgcaaagttgagctagccgctcgattagttacatctcctaagcagtactacaaggaatggtctctatactttcatgtttagcacatggtagtgcggattgacaagttagaaacagtgcttaggagacaaagagtcagtaaaggtattgaaagagtgaagttgatgctcgacaggtcaggagaagtccctccgccagatggtgactaccaaggggttggtatcagctgagacccaaataagattcttcggttgaaccagtggttcgaccgagactcttagggtgggatttcactgtaagatttgtgcattttgttgaatataaattgacaattttttttatttaattatagattatttagaatgaattacatatttagtttctaacaaggatagcaatggatgggtatgggtacaggttaaacatatctattacccacccatctagtcgtcgggttttacacgtacccacccgtttacataaaccagaccggaattttaaaccgtacccgtccgttagcgggtttcagatttacccgtttaatcgggtaaaacctgattactaaatatatattttttatttgataaacaaaacaaaaatgttaatattttcatattggatgcaattttaagaaacacatattcataaatttccatatttgtaggaaaataaaaagaaaaatatattcaagaacacaaatttcaccgacatgacttttattacagagttggaattagatctaacaattgaaaaattaaaattaagatagaatatgttgaggaacatgacatagtataatgctgggttacccgtcgggtaggtatcgaggcggatactactaaatccatcccactcgctatccgataatcactggtttcgggtatacccattcccgtcaacaggcctttttaaccggataatttcaacttatagtgaatgaattttgaataaatagttagaataccaaaatcctggattgcatttgcaatcaaattttgtgaaccgttaaattttgcatgtacttgggatagatataatagaaccgaattttcattagtttaatttataacttactttgttcaaagaaaaaaaatatctatccaatttacttataataaaaaataatctatccaagttacttattataatcaacttgtaaaaaggtaagaatacaaatgtggtagcgtacgtgtgattatatgtgacgaaatgttatatctaacaaaagtccaaattcccatggtaaaaaaaatcaaaatgcatggcaggctgtttgtaaccttggaataagatgttggccaattctggagccgccacgtacgcaagactcagggccacgttctcttcatgcaaggatagtagaacaccactccacccacctcctatattagacctttgcccaaccctccccaactttcccatcccatccacaaagaaaccgacatttttatcataaatcagggtttcgtttttgtttcatcgataaactcaaaggtgatgattttagggtcttgtgagtgtgcttttttgtttgattctactgtagggtttatgttctttagctcataggttttgtgtatttcttagaaatgtggcttctttaatctctgggtttgtgactttttgtgtggtttctgtgtttttcatatcaaaaacctattttttccgagtttttttttacaaattcttactctcaagcttgaatacttcacatgcagtgttcttttgtagattttagagttaatgtgttaaaaagtttggatttttcttgcttatagagcttcttcactttgattttgtgggtttttttgttttaaaggtgagatttttgatgaggtttttgcttcaaagatgtcacctttctgggtttgtcttttgaataaagctatgaactgtcacatggctgacgcaattttgttactatgtcatgaaagctgacgtttttccgtgttatacatgtttgcttacacttgcatgcgtcaaaaaaattggggctttttagttttagtcaaagattttacttctcttttgggatttatgaaggaaagttgcaaactttctcaaattttaccatttttgctttgatgtttgtttagattgcgacagaacaaactcatatatgttgaaatttttgcttggttttgtataggattgtgtcttttgcttataaatgttgaaatctgaactttttttttgtttggtttctttgagcaggagataaggcgcaccaccatggcttctacatctgctgctcaagacgctgctccttacgagttcccttctctcactgagatcaagagggctcttccttctgagtgtttcgaggcttctgttcctctttctctctactacaccgctagatctcttgctcttgctggatctctcgctgttgctctctcttacgctagagctttgcctcttgttcaggctaacgctcttcttgatgctactctctgcactggatacgttcttctccagggaatcgttttctggggattcttcaccgttggtcacgattgtggacacggagctttctctagatctcacgtgctcaacttctctgttggaaccctcatgcactctatcatccttacccctttcgagtcttggaagctctctcacagacaccaccacaagaacaccggaaacatcgataaggacgagatcttctaccctcaaagagaggctgattctcaccctgtttctagacaccttgtgatgtctcttggatctgcttggttcgcttaccttttcgctggattccctcctagaaccatgaaccacttcaacccttgggaggctatgtatgttagaagagtggctgctgtgatcatctctctcggagttcttttcgctttcgctggactctactcttacctcaccttcgttcttggattcaccactatggctatctactacttcggacctctcttcatcttcgctaccatgcttgttgttaccactttcctccaccacaacgatgaggagacaccttggtacgctgattctgagtggacttacgtgaagggaaacctctcttctgtggacagatcttacggtgctctcatcgacaaccttagccacaacatcggaactcaccagatccaccacctcttccctatcatccctcactacaagctcaacgatgctactgctgctttcgctaaggctttccctgagcttgttaggaaaaacgctgctcctatcatcccaactttcttcaggatggctgctatgtacgctaagtacggagttgttgacactgatgctaagaccttcactctcaaggaggctaaggctgctgctaagactaagtcatcttgatgattaatgaaggccgcagatatcagatctggtcgacctagaggatccccggccgcaaagataataacaaaagcctactatataacgtacatgcaagtattgtatgatattaatgtttttacgtacgtgtaaacaaaaataattacgtttgtaacgtatggtgatgatgtggtgcactaggtgtaggccttgtattaataaaaagaagtttgttctatatagagtggtttagtacgacgatttatttactagtcggattggaatagagaaccgaattcttcaatccttgcttttgatcaagaattgaaaccgaatcaaatgtaaaagttgatatatttgaaaaacgtattgagcttatgaaaatgctaatactctcatctgtatggaaaagtgactttaaaaccgaacttaaaagtgacaaaaggggaatatcgcatcaaaccgaatgaaaccgatctacgtaggctcagctgagcttacctaaggctacgtaggctcacgtgacgttacgtaaggctacgtagcgtcacgtgagcttacctaactctagctagcctcacgtgaccttagctaacactaggtagcgtcagcttagcagatatttggtgtctaaatgtttattttgtgatatgttcatgtttgaaatggtggtttcgaaaccagggacaacgttgggatctgatagggtgtcaaagagtattatggattgggacaatttcggtcatgagttgcaaattcaagtatatcgttcgattatgaaaattttcgaagaatatcccatttgagagagtctttacctcattaatgtttttagattatgaaattttatcatagttcatcgtagtctttttggtgtaaaggctgtaaaaagaaattgttcacttttgttttcgtttatgtgaaggctgtaaaagattgtaaaagactattttggtgttttggataaaatgatagtttttatagattcttttgcttttagaagaaatacatttgaaattttttccatgttgagtataaaataccgaaatcgattgaagatcatagaaatattttaactgaaaacaaatttataactgattcaattctctccatttttatacctatttaaccgtaatcgattctaatagatgatcgattttttatataatcctaattaaccaacggcatgtattggataattaaccgatcaactctcacccctaatagaatcagtattttccttcgacgttaattgatcctacactatgtaggtcatatccatcgttttaatttttggccaccattcaattctgtcttgcctttagggatgtgaatatgaacggccaaggtaagagaataaaaataatccaaattaaagcaagagaggccaagtaagataatccaaatgtacacttgtcattgccaaaattagtaaaatactcggcatattgtattcccacacattattaaaataccgtatatgtattggctgcatttgcatgaataatactacgtgtaagcccaaaagaacccacgtgtagcccatgcaaagttaacactcacgaccccattcctcagtctccactatataaacccaccatccccaatctcaccaaacccaccacacaactcacaactcactctcacaccttaaagaaccaatcaccaccaaaaaaagttctttgctttcgaagttgccgcaacctaaacaggtttttccttcttctttcttcttattaactacgaccttgtcctttgcctatgtaaaattactaggttttcatcagttacactgattaagttcgttatagtggaagataaaatgccctcaaagcattttgcaggatatctttgatttttcaaagatatggaactgtagagtttgatagtgttcttgaatgtggttgcatgaagtttttttggtctgcatgttattttttcctcgaaatatgttttgagtccaacaagtgattcacttgggattcagaaagttgttttctcaatatgtaacagtttttttctatggagaaaaatcatagggaccgttggttttggcttctttaattttgagctcagattaaacccattttacccggtgttcttggcagaattgaaaacagtacgtagtaccgcgcctaccatgccacctagtgctgctagtgaaggtggtgttgctgaacttagagctgctgaagttgctagctacactagaaaggctgttgacgaaagacctgacctcactatagttggtgacgctgtttacgacgctaaggcttttagggacgagcaccctggtggtgctcacttcgttagccttttcggaggtagggacgctactgaggcttttatggaatatcaccgtagagcttggcctaaggctaggatgtctaagttcttcgttggttcacttgacgctagcgagaagcctactcaagctgattcagcttaccttagactttgcgctgaggttaacgctcttttgcctaagggtagcggaggattcgctcctcctagctactggcttaaggctgctgctcttgttgttgctgctgttagtatagagggttatatgctccttaggggtaagacccttttgcttagcgttttccttggactcgtgttcgcttggataggacttaatattcagcacgacgctaatcacggtgctcttagtagacactcagtgattaactactgcctcggttacgctcaggattggataggtggtaatatggtgctttggcttcaagagcacgttgtgatgcaccacctccacactaacgacgttgacgctgatcctgatcaaaaggctcacggtgttcttagacttaagcctactgacggttggatgccttggcacgcacttcaacaactctatatccttcctggtgaggctatgtacgcttttaagcttcttttcttggacgcccttgagcttcttgcttggaggtgggagggtgagaagattagccctcttgctagagctttgttcgctcctgctgttgcttgtaagcttggattctgggctagattcgttgctctccctctctggcttcaacctactgttcacactgctttgtgtatctgtgctactgtgtgtactggtagcttctacctcgccttcttcttctttatctctcacaacttcgacggtgttggtagcgttggacctaagggatcacttcctagatcagctactttcgttcaacgtcaggttgagactagctctaacgttggtggttactggcttggagttcttaacggtggacttaactttcagatagagcaccacttgttccctaggcttcaccactcttactacgctcaaatagctcctgtggttaggactcacatagagaagctcggttttaagtaccgtcacttccctaccgttggatctaaccttagctcaatgcttcagcatatgggtaagatgggaactagacctggtgctgagaagggtggtaaggctgagtagtgattaatgaataattgattgctgctttaatgagatatgcgagacgcctatgatcgcatgatatttgctttcaattctgttgtgcacgttgtaaaaaacctgagcatgtgtagctcagatccttaccgccggtttcggttcattctaatgaatatatcacccgttactatcgtatttttatgaataatattctccgttcaatttactgattgtctacgtagcgtcacctgacgttacgtaaggctacctaggctcacgtgacgttacgtaacgctacgtagcgtcaggtgaggttagctaacgctagctagcctcacctgacgttaggtaaggctacgtagcgtcacctgagattagctaagcctacctagactcacgtgaccttaggtaacgctacgtagcgtcaaagctttacaacgctacacaaaacttataaccgtaatcaccattcattaacttaactactatcacatgcattcatgaattgaaacgagaaggatgtaaatagttgggaagttatctccacgttgaagagatcgttagcgagagctgaaagaccgagggaggagacgccgtcaacacggacagagtcgtcgaccctcacatgaagtaggaggaatctccgtgaggagccagagagacgtctttggtcttcggtttcgatccttgatctgacggagaagacgagagaagtgcgactggactccgtgaggaccaacagagtcgtcctcggtttcgatcgtcggtattggtggagaaggcggaggaatctccgtgacgagccagagagatgtcgtcggtcttcggtttcgatccttgatctgacggagaagacgagagaagtgcgacgagactccgtgaggaccaacagagttgtcctcggtttcgatcgtcggtttcggcggagaaggcggaggaatctccgtgaggagccagagagacgtcgttggtcttcggtttcgatccttgatctgttggagaagacgagacaagtgggacgagactcaacgacggagtcagagacgtcgtcggtcttcggtttcggccgagaaggcggagtcggtcttcggtttcggccgagaaggcggaggagacgtcttcgatttgggtctctcctcttgacgaagaaaacaaagaacacgagaaataatgagaaagagaacaaaagaaaaaaaaataaaaataaaaataaaatttggtcctcttatgtggtgacacgtggtttgaaacccaccaaataatcgatcacaaaaaacctaagttaaggatcggtaataacctttctaattaattttgatttatattaaatcactctttttatttataaaccccactaaattatgcgatattgattgtctaagtacaaaaattctctcgaattcaatacacatgtttcatatatttagccctgttcatttaatattactagcgcatttttaatttaaaattttgtaaacttttttggtcaaagaacatttttttaattagagacagaaatctagactctttatttggaataatagtaataaagatatattaggcaatgagtttatgatgttatgtttatatagtttatttcattttaaattgaaaagcattatttttatcgaaatgaatctagtatacaatcaatatttatgttttttcatcagatactttcctattttttggcacctttcatcggactactgatttatttcaatgtgtatgcatgcatgagcatgagtatacacatgtcttttaaaatgcatgtaaagcgtaacggaccacaaaagaggatccatacaaatacatctcatcgcttcctctactattctccgacacacacactgagcatggtgcttaaacactctggtgagttctagtacttctgctatgatgttaaattttatattatatacctacttcctctctctcgctctgttatgttcgatttcgaaaggatttcaagatcaaagatgatgagaaaaggtaccttttcgatatttaagacaaggaaagaaaggacgaggttgaaattttcgggacttggagggctaaagtggaagagactgaatctgaagatgtcgtttctcgaaactttgagatacagaatcatgtctatcattgaaggaatggttttggtttctaagcttgctttcttctttctctgttgcggttgcagattttaacacgttagttttttttttttcgtttttttgaacgtcaacaatgtcttttttgtactctttagctcatgtgtaaaattctaaattcttccaataacatacccaacaaattattcgtatctgatttttatagtttttaacctgttaatgtaattaatctaagtgtaatttttaggctaaatgttaaattttatattaaagttttgtaacttgaaattacattcttcttatagcggataaacagaaaatgctcttaaacaaatcctgaaacaagtaaaaaatacaacagaaaaatctaacgtttaattcttaaaacctcaaaatccttatttttacagctttcaaagtttaacagctggaaacctgtagaaaatcagacacagcctctcaagttttctggacaataaatactggtaacgtaagaaaaccaattaatgataccgtcgttcagtagatagaactgacgatgtgaagattaattgtttctgtaatatactgaatttgaaaatttatcatcatcatgttaacggaagttgtctgtaaaagtagttgattacctgttatcgtgtaaagtagttagtaatttcttgcttatttgaaaaatagagaacatttaacatgtatttttaaataggcacgaccatgctactgaactttatgaaatgctttggaatcttat

SEQ ID NO: 308 - DNA, 37487 bp, Artificial Sequence
  T-DNA insertion in LBFDAU Locus 2, including left and right border sequences
ttggggtgagagttgatcggttaattatccaatacatgccgttggttaattaggattatataaaaaatcgatcatctattagaatcgattacggttaaataggtataaaaatggagagaattgaatcagttataaatttgttttcagttaaaatatttctatgatcttcaatcgatttcggtattttatactcaacatggaaaaaatttcaaatgtatttcttctaaaagcaaaagaatctataaaaactatcattttatccaaaacaccaaaatagtcttttacaatcttttacagccttcacataaacgaaaacaaaagtgaacaatttctttttacagcctttacaccaaaaagactacgatgaactatgataaaatttcataatctaaaaacattaatgaggtaaagactctctcaaatgggatattcttcgaaaattttcataatcgaacgatatacttgaatttgcaactcatgaccgaaattgtcccaatccataatactctttgacaccctatcagatcccaacgttgtccctggtttcgaaaccaccatttcaaacatgaacatatcacaaaataaacatttagacaccaaatatctgctaagcgcttacgtaagctcagctgacgctacctagcgttagctaacgtcacgtgacgctacctagcgttacgtaacgtcagctgaggctagctagctgaattaacgccgaattaattcgggggatctggattttagtactggattttggttttaggaattagaaattttattgatagaagtattttacaaatacaaatacatactaagggtttcttatatgctcaacacatgagcgaaaccctataggaaccctaattcccttatctgggaactactcacacattattatggagaaactcgagcttgtcgatcactcggtcttagctcccttttgctttccatcggatggcttgatgtacttttgcacgtagaagtttccgaagaggaacaagagggagatcatgtagtagaagaggatcttgatgagccattgtggatatggagcgttggttttcatatcgtagtaagcttgcaccaagttgagcatgaactggaacatctggaattgggtgaggtatcttccccagaagaggtacttgttcttgagctttggggaagatctcaagcaagcagccaagaagtagtaagcgtacatcaacacgtgcactccagagttgagagcagcactccaataagcctctcctcctggagcgtggtgagcaatagcccaccagataagggagatagaagagtggtggtacacgtggaggaaagaaatctgtctggtggatctcttgaggatcatgatcacggtatccatgaactccacgtacttggacatgtagaagaggtaaacgaggatagccatctccttgtgctttgggttataagcgtttccccacaaggaatatctccaggtgatagcttggtaagcgatacccacgcacatgtaaagagacaaagcgaagcagaacaagttgtgcaccaacaccaaagcttgcaacaagaatggctcagaagctcttggcttgagatctctagccttgatccaaagcaatcctccgatcacgatggtcaagtaaacagacactcccaacacaattggagttggagaatcaacgagtggcaatcccttagtagttggggtatcagtcaactcaactccgaaagatcccaacaaagcgttcactccttgggaaacctttccatccaactctccgtagaacctctcaacaacttccatggtttcttctaaagctgaaagtgaaccattattacaacttaacactcaactcacaagaggagaagcaacaaagcttatgtaaggatttagtattaaggccaaaaaaacacagatcaaattcaattattgaagctttacttatcaagttatcatataaccaatgaagacggtaattcaaaagaaaaataaaagggtttgtagaataattgatacgtttacctttgccgattcagagacagtgaagcttaaacagtactggctatgaagaaattataatcgtgtaaaacttagtgagtgtgtatgaatgaaagtattgcaaaatcctcattatatagactacatgcataactagttgcatgtaaatttgtagttttcttcattattgcatcctccaagtggatgtcatggttttacacatggcttccatgcaaatcatttccaaaatatttttaaactttccacagggcatccatgcatgcacctcaaaacttgtgtgtggtaacattgttgtcttgaaaaattactaaaccttttgtccacgtgacgttcatgcacctcaaatcttgtgtggtaccattattatcctcaagaattattgaatgtttggtgtatatgccatccatgcagcattgcaacaattaaatctccaaaccttgtggtaccatattcactcactttaattctcctatagtagaaatattagcaaatatttacatttccagttgattagtatatgtatttagaagacaaaaataatttagaatcaattaatcaacttgcaaattgctaagtgttggcaaacgttagcataaaaggtgttataaatttagtaccaaatataaaaatttatcgcaaatcaaatacataacacacatagtaaaacaaaaacaaattacaagggtttagacgtttagtggcaatgtgtaaatttgctgcaggagtgacgctagctagcgttacgtaacgtcagctgagcctaggtagcgttagctaagctcacgtgacgctacgtaggcttacgtaacgtcagctgaggctacgtagcgttagctaacgtcacgtgacgctacgtaggcttacgtaatagttactaatcagtgatcaggcgcgccattaatttccaccttcacctacgatggggggcatcgcaccggtgagtaatattgtacggctaagagcgaatttggcctgtagacctcaattgcgagctttctaatttcaaactattcgggcctaacttttggtgtgatgatgctgactgtttcgacgttaattgatcctacactatgtaggtcatatccatcgttttaatttttggccaccattcaattctgtcttgcctttagggatgtgaatatgaacggccaaggtaagagaataaaaataatccaaattaaagcaagagaggccaagtaagataatccaaatgtacacttgtcattgccaaaattagtaaaatactcggcatattgtattcccacacattattaaaataccgtatatgtattggctgcatttgcatgaataatactacgtgtaagcccaaaagaacccacgtgtagcccatgcaaagttaacactcacgaccccattcctcagtctccactatataaacccaccatccccaatctcaccaaacccaccacacaactcacaactcactctcacaccttaaagaaccaatcaccaccaaaaaatttcacgatttggaatttgattcctgcgatcacaggtatgacaggttagattttgttttgtatagttgtatacatacttctttgtgatgttttgtttacttaatcgaatttttggagtgttttaaggtctctcgtttagaaatcgtggaaaatatcactgtgtgtgtgttcttatgattcacagtgtttatgggtttcatgttctttgttttatcattgaatgggaagaaatttcgttgggatacaaatttctcatgttcttactgatcgttattaggagtttggggaaaaaggaagagtttttttggttggttcgagtgattatgaggttatttctgtatttgatttatgagttaatggtcgttttaatgttgtagacatgggaaaaggatctgagggaagatctgctgctagagagatgactgctgaggctaacggagataagagaaagaccatcctcattgagggagtgttgtacgatgctaccaacttcaaacacccaggaggttccattattaacttcctcaccgagggagaagctggagttgatgctacccaagcttacagagagttccatcagagatccggaaaggctgataagtacctcaagtccctcccaaagttggatgcttctaaggtggagtctaggttctctgctaaggagcaggctagaagggacgctatgaccagggattacgctgctttcagagaggagttggttgctgagggatacttcgatccatctatcccacacatgatctacagagtggtggagattgtggctttgttcgctttgtctttctggttgatgtctaaggcttctccaacctctttggttttgggagtggtgatgaacggaatcgctcaaggaagatgcggatgggttatgcacgagatgggacacggatctttcactggagttatctggctcgatgataggatgtgcgagttcttctacggagttggatgtggaatgtctggacactactggaagaaccagcactctaagcaccacgctgctccaaacagattggagcacgatgtggatttgaacaccttgccactcgttgctttcaacgagagagttgtgaggaaggttaagccaggatctttgttggctttgtggctcagagttcaggcttatttgttcgctccagtgtcttgcttgttgatcggattgggatggaccttgtacttgcacccaagatatatgctcaggaccaagagacacatggagtttgtgtggatcttcgctagatatatcggatggttctccttgatgggagctttgggatattctcctggaacttctgtgggaatgtacctctgctctttcggacttggatgcatctacatcttcctccaattcgctgtgtctcacacccacttgccagttaccaacccagaggatcaattgcactggcttgagtacgctgctgatcacaccgtgaacatctctaccaagtcttggttggttacctggtggatgtctaacctcaacttccaaatcgagcaccacttgttcccaaccgctccacaattcaggttcaaggagatctctccaagagttgaggctctcttcaagagacacaacctcccttactacgatttgccatacacctctgctgtttctactaccttcgctaacctctactctgttggacactctgttggagctgataccaagaagcaggattgactgctttaatgagatatgcgagacgcctatgatcgcatgatatttgctttcaattctgttgtgcacgttgtaaaaaacctgagcatgtgtagctcagatccttaccgccggtttcggttcattctaatgaatatatcacccgttactatcgtatttttatgaataatattctccgttcaatttactgattgtctacgtaggctcagctgagcttacctaaggctacgtaggctcacgtgacgttacgtaaggctacgtagcgtcacgtgagcttacctaactctagctagcctcacgtgaccttagctaacactaggtagcgtcagctcgacggcccggactgtatccaacttctgatctttgaatctctctgttccaacatgttctgaaggagttctaagacttttcagaaagcttgtaacatgctttgtagactttctttgaattactcttgcaaactctgattgaacctacgtgaaaactgctccagaagttctaaccaaattccgtcttgggaaggcccaaaatttattgagtacttcagtttcatggacgtgtcttcaaagatttataacttgaaatcccatcatttttaagagaagttctgttccgcaatgtcttagatctcattgaaatctacaactcttgtgtcagaagttcttccagaatcaacttgcatcatggtgaaaatctggccagaagttctgaacttgtcatatttcttaacagttagaaaaatttctaagtgtttagaattttgacttttccaaagcaaacttgacttttgactttcttaataaaacaaacttcatattctaacatgtcttgatgaaatgtgattcttgaaatttgatgttgatgcaaaagtcaaagtttgacttttcagtgtgcaattgaccattttgctcttgtgccaattccaaacctaaattgatgtatcagtgctgcaaacttgatgtcatggaagatcttatgagaaaattcttgaagactgagaggaaaaattttgtagtacaacacaaagaatcctgtttttcatagtcggactagacacattaacataaaacaccacttcattcgaagagtgattgaagaaggaaatgtgcagttacctttctgcagttcataagagcaacttacagacacttttactaaaatactacaaagaggaagattttaacaacttagagaagtaatgggagttaaagagcaacacattaagggggagtgttaaaattaatgtgttgtaaccaccactacctttagtaagtattataagaaaattgtaatcatcacattataattattgtccttatttaaaattatgataaagttgtatcattaagattgagaaaaccaaatagtcctcgtcttgatttttgaattattgttttctatgttacttttcttcaagcctatataaaaactttgtaatgctaaattgtatgctggaaaaaaatgtgtaatgaattgaatagaaattatggtatttcaaagtccaaaatccatcaatagaaatttagtacaaaacgtaactcaaaaatattctcttattttaaattttacaacaatataaaaatattctcttattttaaattttacaataatataatttatcacctgtcacctttagaataccaccaacaatattaatacttagatattttattcttaataattttgagatctctcaatatatctgatatttattttatatttgtgtcatattttcttatgttttagagttaacccttatatcttggtcaaactagtaattcaatatatgagtttgtgaaggacacattgacatcttgaaacattggttttaaccttgttggaatgttaaaggtaataaaacattcagaattatgaccatctattaatatacttcctttgtcttttaaaaaagtgtgcatgaaaatgctctatggtaagctagagtgtcttgctggcctgtgtatatcaattccatttccagatggtagaaactgccactacgaataattagtcataagacacgtatgttaacacacgtccccttgcatgttttttgccatatattccgtctctttctttttcttcacgtataaaacaatgaactaattaatagagcgatcaagctgaacagttctttgctttcgaagttgccgcaacctaaacaggtttttccttcttctttcttcttattaactacgaccttgtcctttgcctatgtaaaattactaggttttcatcagttacactgattaagttcgttatagtggaagataaaatgccctcaaagcattttgcaggatatctttgatttttcaaagatatggaactgtagagtttgatagtgttcttgaatgtggttgcatgaagtttttttggtctgcatgttattttttcctcgaaatatgttttgagtccaacaagtgattcacttgggattcagaaagttgttttctcaatatgtaacagtttttttctatggagaaaaatcatagggaccgttggttttggcttctttaattttgagctcagattaaacccattttacccggtgttcttggcagaattgaaaacagtacgtagtaccgcgcctaccatgtgtgttgagaccgagaacaacgatggaatccctactgtggagatcgctttcgatggagagagagaaagagctgaggctaacgtgaagttgtctgctgagaagatggaacctgctgctttggctaagaccttcgctagaagatacgtggttatcgagggagttgagtacgatgtgaccgatttcaaacatcctggaggaaccgtgattttctacgctctctctaacactggagctgatgctactgaggctttcaaggagttccaccacagatctagaaaggctaggaaggctttggctgctttgccttctagacctgctaagaccgctaaagtggatgatgctgagatgctccaggatttcgctaagtggagaaaggagttggagagggacggattcttcaagccttctcctgctcatgttgcttacagattcgctgagttggctgctatgtacgctttgggaacctacttgatgtacgctagatacgttgtgtcctctgtgttggtttacgcttgcttcttcggagctagatgtggatgggttcaacacgagggaggacactcttctttgaccggaaacatctggtgggataagagaatccaagctttcactgctggattcggattggctggatctggagatatgtggaactccatgcacaacaagcaccacgctactcctcaaaaagtgaggcacgatatggatttggataccactcctgctgttgctttcttcaacaccgctgtggaggataatagacctaggggattctctaagtactggctcagattgcaagcttggaccttcattcctgtgacttctggattggtgttgctcttctggatgttcttcctccacccttctaaggctttgaagggaggaaagtacgaggagcttgtgtggatgttggctgctcacgtgattagaacctggaccattaaggctgttactggattcaccgctatgcaatcctacggactcttcttggctacttcttgggtttccggatgctacttgttcgctcacttctctacttctcacacccacttggatgttgttcctgctgatgagcacttgtcttgggttaggtacgctgtggatcacaccattgatatcgatccttctcagggatgggttaactggttgatgggatacttgaactgccaagtgattcaccacctcttcccttctatgcctcaattcagacaacctgaggtgtccagaagattcgttgctttcgctaagaagtggaacctcaactacaaggtgatgacttatgctggagcttggaaggctactttgggaaacctcgataatgtgggaaagcactactacgtgcacggacaacactctggaaagaccgcttgattaatgaaggccgcctcgaccgtaccccctgcagatagactatactatgttttagcctgcctgctggctagctactatgttatgttatgttgtaaaataaacacctgctaaggtatatctatctatattttagcatggctttctcaataaattgtctttccttatcgtttactatcttatacctaataatgaaataataatatcacatatgaggaacggggcaggtttaggcatatatatacgagtgtagggcggagtggggctacgtagcgtcacgtgacgttacctaagcctaggtagcctcagctgacgttacgtaacgctaggtaggctcagctgacacgggcaggacatagggactactacaagcatagtatgcttcagacaaagagctaggaaagaactcttgatggaggttaagagaaaaaagtgctagaggggcatagtaatcaaacttgtcaaaaccgtcatcatgatgagggatgacataatataaaaagttgactaaggtcttggtagtactctttgattagtattatatattggtgagaacatgagtcaagaggagacaagaaaccgaggaaccatagtttagcaacaagatggaagttgcaaagttgagctagccgctcgattagttacatctcctaagcagtactacaaggaatggtctctatactttcatgtttagcacatggtagtgcggattgacaagttagaaacagtgcttaggagacaaagagtcagtaaaggtattgaaagagtgaagttgatgctcgacaggtcaggagaagtccctccgccagatggtgactaccaaggggttggtatcagctgagacccaaataagattcttcggttgaaccagtggttcgaccgagactcttagggtgggatttcactgtaagatttgtgcattttgttgaatataaattgacaattttttttatttaattatagattatttagaatgaattacatatttagtttctaacaaggatagcaatggatgggtatgggtacaggttaaacatatctattacccacccatctagtcgtcgggttttacacgtacccacccgtttacataaaccagaccggaattttaaaccgtacccgtccgttagcgggtttcagatttacccgtttaatcgggtaaaacctgattactaaatatatattttttatttgataaacaaaacaaaaatgttaatattttcatattggatgcaattttaagaaacacatattcataaatttccatatttgtaggaaaataaaaagaaaaatatattcaagaacacaaatttcaccgacatgacttttattacagagttggaattagatctaacaattgaaaaattaaaattaagatagaatatgttgaggaacatgacatagtataatgctgggttacccgtcgggtaggtatcgaggcggatactactaaatccatcccactcgctatccgataatcactggtttcgggtatacccattcccgtcaacaggcctttttaaccggataatttcaacttatagtgaatgaattttgaataaatagttagaataccaaaatcctggattgcatttgcaatcaaattttgtgaaccgttaaattttgcatgtacttgggatagatataatagaaccgaattttcattagtttaatttataacttactttgttcaaagaaaaaaaatatctatccaatttacttataataaaaaataatctatccaagttacttattataatcaacttgtaaaaaggtaagaatacaaatgtggtagcgtacgtgtgattatatgtgacgaaatgttatatctaacaaaagtccaaattcccatggtaaaaaaaatcaaaatgcatggcaggctgtttgtaaccttggaataagatgttggccaattctggagccgccacgtacgcaagactcagggccacgttctcttcatgcaaggatagtagaacaccactccacccacctcctatattagacctttgcccaaccctccccaactttcccatcccatccacaaagaaaccgacatttttatcataaatctggtgcttaaacactctggtgagttctagtacttctgctatgatcgatctcattaccatttcttaaatttctctccctaaatattccgagttcttgatttttgataacttcaggttttctctttttgataaatctggtctttccattttttttttttgtggttaatttagtttcctatgttcttcgattgtattatgcatgatctgtgtttggattctgttagattatgtattggtgaatatgtatgtgtttttgcatgtctggttttggtcttaaaaatgttcaaatctgatgatttgattgaagcttttttagtgttggtttgattcttctcaaaactactgttaatttactatcatgttttccaactttgattcatgatgacacttttgttctgctttgttataaaattttggttggtttgattttgtaattatagtgtaattttgttaggaatgaacatgttttaatactctgttttcgatttgtcacacattcgaattattaatcgataatttaactgaaaattcatggttctagatcttgttgtcatcagattatttgtttcgataattcatcaaatatgtagtccttttgctgatttgcgactgtttcattttttctcaaaattgttttttgttaagtttatctaacagttatcgttgtcaaaagtctctttcattttgcaaaatcttctttttttttttgtttgtaactttgttttttaagctacacatttagtctgtaaaatagcatcgaggaacagttgtcttagtagacttgcatgttcttgtaacttctatttgtttcagtttgttgatgactgctttgattttgtaggtcaaaggcgcaccctaccatggatgcttataacgctgctatggataagattggagctgctatcatcgattggagtgatccagatggaaagttcagagctgatagggaggattggtggttgtgcgatttcagatccgctatcaccattgctctcatctacatcgctttcgtgatcttgggatctgctgtgatgcaatctctcccagctatggacccataccctatcaagttcctctacaacgtgtctcaaatcttcctctgcgcttacatgactgttgaggctggattcctcgcttataggaacggatacaccgttatgccatgcaaccacttcaacgtgaacgatccaccagttgctaacttgctctggctcttctacatctccaaagtgtgggatttctgggataccatcttcattgtgctcggaaagaagtggagacaactctctttcttgcacgtgtaccaccacaccaccatcttcctcttctactggttgaacgctaacgtgctctacgatggagatatcttcttgaccatcctcctcaacggattcattcacaccgtgatgtacacctactacttcatctgcatgcacaccaaggattctaagaccggaaagtctttgccaatctggtggaagtcatctttgaccgctttccaactcttgcaattcaccatcatgatgtcccaagctacctacttggttttccacggatgcgataaggtttccctcagaatcaccatcgtgtacttcgtgtacattctctcccttttcttcctcttcgctcagttcttcgtgcaatcctacatggctccaaagaagaagaagtccgcttgatgttaatgaaggccgcagatatcagatctggtcgacctagaggatccccggccgcaaagataataacaaaagcctactatataacgtacatgcaagtattgtatgatattaatgtttttacgtacgtgtaaacaaaaataattacgtttgtaacgtatggtgatgatgtggtgcactaggtgtaggccttgtattaataaaaagaagtttgttctatatagagtggtttagtacgacgatttatttactagtcggattggaatagagaaccgaattcttcaatccttgcttttgatcaagaattgaaaccgaatcaaatgtaaaagttgatatatttgaaaaacgtattgagcttatgaaaatgctaatactctcatctgtatggaaaagtgactttaaaaccgaacttaaaagtgacaaaaggggaatatcgcatcaaaccgaatgaaaccgatctacgtaggctcagctgagcttagctaagcctacctagcctcacgtgagattatgtaaggctaggtagcgtcacgtgacgttacctaacactagctagcgtcagctgagcttagctaaccctacgtagcctcacgtgagcttacctaacgctacgtagcctcacgtgactaaggatgacctacccattcttgagacaaatgttacattttagtatcagagtaaaatgtgtacctataactcaaattcgattgacatgtatccattcaacataaaattaaaccagcctgcacctgcatccacatttcaagtattttcaaaccgttcggctcctatccaccgggtgtaacaagacggattccgaatttggaagattttgactcaaattcccaatttatattgaccgtgactaaatcaactttaacttctataattctgattaagctcccaatttatattcccaacggcactacctccaaaatttatagactctcatccccttttaaaccaacttagtaaacgttttttttttaattttatgaagttaagtttttaccttgtttttaaaaagaatcgttcataagatgccatgccagaacattagctacacgttacacatagcatgcagccgcggagaattgtttttcttcgccacttgtcactcccttcaaacacctaagagcttctctctcacagcacacacatacaatcacatgcgtgcatgcattattacacgtgatcgccatgcaaatctcctttatagcctataaattaactcatcggcttcactctttactcaaaccaaaactcatcaatacaaacaagattaaaaacatttcacgatttggaatttgattcctgcgatcacaggtatgacaggttagattttgttttgtatagttgtatacatacttctttgtgatgttttgtttacttaatcgaatttttggagtgttttaaggtctctcgtttagaaatcgtggaaaatatcactgtgtgtgtgttcttatgattcacagtgtttatgggtttcatgttctttgttttatcattgaatgggaagaaatttcgttgggatacaaatttctcatgttcttactgatcgttattaggagtttggggaaaaaggaagagtttttttggttggttcgagtgattatgaggttatttctgtatttgatttatgagttaatggtcgttttaatgttgtagaccgccatggctattttgaaccctgaggctgattctgctgctaacctcgctactgattctgaggctaagcaaagacaattggctgaggctggatacactcacgttgagggtgctcctgctcctttgcctttggagttgcctcacttctctctcagagatctcagagctgctattcctaagcactgcttcgagagatctttcgtgacctccacctactacatgatcaagaacgtgttgacttgcgctgctttgttctacgctgctaccttcattgatagagctggagctgctgcttatgttttgtggcctgtgtactggttcttccagggatcttacttgactggagtgtgggttatcgctcacgagtgtggacaccaggcttattgctcttctgaggtggtgaacaacttgattggactcgtgttgcactctgctttgttggtgccttaccactcttggagaatctctcacagaaagcaccactccaacactggatcttgcgagaacgatgaggttttcgttcctgtgaccagatctgtgttggcttcttcttggaacgagaccttggaggattctcctctctaccaactctaccgtatcgtgtacatgttggttgttggatggatgcctggatacctcttcttcaacgctactggacctactaagtactggggaaagtctaggtctcacttcaacccttactccgctatctatgctgatagggagaggtggatgatcgtgctctccgatattttcttggtggctatgttggctgttttggctgctttggtgcacactttctccttcaacacgatggtgaagttctacgtggtgccttacttcattgtgaacgcttacttggtgttgattacctacctccaacacaccgatacctacatccctcacttcagagagggagagtggaattggttgagaggagctttgtgcactgtggatagatcatttggtccattcctcgattctgtggtgcatagaatcgtggatacccacgtttgccaccatatcttctccaagatgcctttctatcactgcgaggaggctaccaacgctattaagcctctcctcggaaagttctacttgaaggatactactcctgttcctgttgctctctggagatcttacacccactgcaagttcgttgaggatgatggaaaggtggtgttctacaagaacaagttatagttaatgaataattgattggttcgagtattatggcattgggaaaactgtttttcttgtaccatttgttgtgcttgtaatttactgtgttttttattcggttttcgctatcgaactgtgaaatggaaatggatggagaagagttaatgaatgatatggtccttttgttcattctcaaattaatattatttgttttttctcttatttgttgtgtgttgaatttgaaattataagagatatgcaaacattttgttttgagtaaaaatgtgtcaaatcgtggcctctaatgaccgaagttaatatgaggagtaaaacacttgtagttgtaccattatgcttattcactaggcaacaaatatattttcagacctagaaaagctgcaaatgttactgaatacaagtatgtcctcttgtgttttagacatttatgaactttcctttatgtaattttccagaatccttgtcagattctaatcattgctttataattatagttatactcatggatttgtagttgagtatgaaaatattttttaatgcattttatgacttgccaattgattgacaacatgcatcaatctagctagcctcagctgacgttacgtaacgctaggtagcgtcacgtgacgttagctaacgctaggtagcgtcagctgagcttacgtaagcgcacagatgaatactagctgttgttcacagttctagtgtctcctcattacgtgaattcaagctacgatcactatctcaactcctacataaacatcagaatgctacaaaactatgcacaaaaacaaaagctacatctaatacgtgaatcaattactctcatcacaagaaagaagatttcaatcaccgtcgagaaggaggattcagttaattgaatcaaagttccgatcaaactcgaagactggtgagcacgaggacgacgaagaagagtgtctcgaagatacaacaagcaagaaatctactgagtgacctcctgaagttattggcgcgattgagagaatcaatccgaattaatttcggggaaaaagataaattagatactaagcgatgggcttgggctgggctaagaaacaggtggcaattgggctggaggaccccgcgattcatagcttccgatagcccaaaaaaaaacggataacatatttatcgggtatttgaatttcagtgaaataagatattttctttttgttaggaaaattttagaaaataatggaaattaaatagcgattatgttacaagatacgatcagcatcgggcagtgcaaaatgctatagcttcccaagatttgatccttttgggttatctcctaatgacaattagtttaggattttgaaacttatattaatactattatccgacaacacttgtttcagcttcttattttaacattttttgtttttttctattcttcttcccatcagcattttctttttaaaaaattgaatactttaactttttaaaaatttcacaatgatcagatgatattatggaagatctcaagagttaaatgtatccatcttggggcattaaaaccggtgtacgggatgataaatacagactttatatcatatgatagctcagtaattcatatttatcacgttgctaaaaaaattataaggtactagtagtcaacaaaatcaattaaagagaaagaaagaaacgcatgtgaagagagtttacaactggaaaagtaaaataaaaattaacgcatgttgaatgctgacatgtcagtatgtccatgaatccacgtatcaagcgccattcatcgatcgtcttcctctttctaaatgaaaacaacttcacacatcacaacaaacaatacacacaagaccccctctctctcgttgtctctctgccagcgaccaaatcgaagcttgagaagaacaagaaggggtcaaaccatggcttctacatctgctgctcaagacgctgctccttacgagttcccttctctcactgagatcaagagggctcttccttctgagtgtttcgaggcttctgttcctctttctctctactacaccgctagatctcttgctcttgctggatctctcgctgttgctctctcttacgctagagctttgcctcttgttcaggctaacgctcttcttgatgctactctctgcactggatacgttcttctccagggaatcgttttctggggattcttcaccgttggtcacgattgtggacacggagctttctctagatctcacgtgctcaacttctctgttggaaccctcatgcactctatcatccttacccctttcgagtcttggaagctctctcacagacaccaccacaagaacaccggaaacatcgataaggacgagatcttctaccctcaaagagaggctgattctcaccctgtttctagacaccttgtgatgtctcttggatctgcttggttcgcttaccttttcgctggattccctcctagaaccatgaaccacttcaacccttgggaggctatgtatgttagaagagtggctgctgtgatcatctctctcggagttcttttcgctttcgctggactctactcttacctcaccttcgttcttggattcaccactatggctatctactacttcggacctctcttcatcttcgctaccatgcttgttgttaccactttcctccaccacaacgatgaggagacaccttggtacgctgattctgagtggacttacgtgaagggaaacctctcttctgtggacagatcttacggtgctctcatcgacaaccttagccacaacatcggaactcaccagatccaccacctcttccctatcatccctcactacaagctcaacgatgctactgctgctttcgctaaggctttccctgagcttgttaggaaaaacgctgctcctatcatcccaactttcttcaggatggctgctatgtacgctaagtacggagttgttgacactgatgctaagaccttcactctcaaggaggctaaggctgctgctaagactaagtcatcttgatgattaatgaataattgattgtacatactatattttttgtttaccttgtgttagtttaatgttcagtgtcctctctttattgtggcacgtctctttgttgtatgttgtgtctatacaaagttgaaataatggaaagaaaaggaagagtgtaatttgttttgttttaagtgtttataaatatatatatataggtcatttagatagttctaggtttctataaaactctctctctggaagtagaatctgtttttgagaggatccagttgcctactaatctcccccaaaacccttcaagcttaaccttcctcttcacaacaacagaggaaacacatctcttgagctctgagttctcttctttgagcatgtctatcgctaaactcatctgccttatagcttccctcttctcttcatctctctctctcaccatttcgctgtaaaacttattctcctccctcagcctctctatctcttccttcagcatctcacaattcccaccataatcgactgaggatgattcaccgtcatcaacttcagactcagcgttgtagtcgtcatgagtctcacaagccttggaccaagaagactcatcatcgcaagttgatgatttatcatgatgcttctctgagccgtgtttgctacgtagcgtcacgtgacgttacctaagcctaggtagcctcagctgacgttacgtaacgctaggtaggctcagctgactgcagcaaatttacacattgccactaaacgtctaaacccttgtaatttgtttttgttttactatgtgtgttatgtatttgatttgcgataaatttttatatttggtactaaatttataacaccttttatgctaacgtttgccaacacttagcaatttgcaagttgattaattgattctaaattatttttgtcttctaaatacatatactaatcaactggaaatgtaaatatttgctaatatttctactataggagaattaaagtgagtgaatatggtaccacaaggtttggagatttaattgttgcaatgctgcatggatggcatatacaccaaacattcaataattcttgaggataataatggtaccacacaagatttgaggtgcatgaacgtcacgtggacaaaaggtttagtaatttttcaagacaacaatgttaccacacacaagttttgaggtgcatgcatggatgccctgtggaaagtttaaaaatattttggaaatgatttgcatggaagccatgtgtaaaaccatgacatccacttggaggatgcaataatgaagaaaactacaaatttacatgcaactagttatgcatgtagtctatataatgaggattttgcaatactttcattcatacacactcactaagttttacacgattataatttcttcatagccagtactgtttaagcttcactgtctctgaatcggcaaaggtaaacgtatcaattattctacaaacccttttatttttcttttgaattaccgtcttcattggttatatgataacttgataagtaaagcttcaataattgaatttgatctgtgtttttttggccttaatactaaatccttacataagctttgttgcttctcctcttgtgagttgagtgttaagttgtaataatggttcactttcagctttagaagaaacgcgccttccatggctacaaaggaggcttacgttttcccaactctcaccgagatcaagagatctctcccaaaggattgcttcgaggcttctgtgcctttgtctctctactacactgtgagatgcttggttattgctgtggctttgaccttcggattgaactacgctagagctttgccagaggttgagtctttctgggctttggatgctgctttgtgcactggatatatcctcctccagggaattgtgttctggggattcttcactgttggacacgatgctggacacggagctttctctagataccacctcttgaacttcgttgtgggaaccttcatgcactctctcatcttgaccccattcgagtcttggaagttgacccacagacaccaccacaagaacaccggaaacatcgatagagatgaggtgttctacccacagagaaaggctgatgatcacccattgtccaggaacttgatcttggctttgggagctgcttggcttgcttatttggtggagggattcccaccaagaaaggtgaaccacttcaacccattcgagccactttttgtgagacaagtgtccgctgtggttatctctttgctcgctcacttcttcgttgctggactctctatctacttgtctctccagttgggacttaagaccatggctatctactactacggaccagttttcgtgttcggatctatgttggtgattaccaccttcttgcaccacaacgatgaggagactccatggtatgctgattctgagtggacttacgtgaagggaaacttgtcctctgtggatagatcttacggtgctctcatcgataacctctcccacaacatcggaactcaccagatccaccacctcttcccaattatcccacactacaagctcaagaaggctactgctgctttccaccaagctttcccagagcttgtgagaaagtccgatgagccaatcatcaaggctttcttcagagtgggaaggttgtatgctaactacggagtggttgatcaagaggctaagctcttcactttgaaggaggctaaggctgctactgaagctgctgctaagaccaagtctacctgattaatgaatcgacaagctcgagtttctccataataatgtgtgagtagttcccagataagggaattagggttcctatagggtttcgctcatgtgttgagcatataagaaacccttagtatgtatttgtatttgtaaaatacttctatcaataaaatttctaattcctaaaaccaaaatccagtactaaaatccagatcccccgaattaattcggcgttaattcagctacgtaggctcagctgagcttacctaaggctacgtaggctcacgtgacgttacgtaaggctacgtagcgtcacgtgagcttacctaactctagctagcctcacgtgaccttagctaacactaggtagcgtcagcacagatgaatactagctgttgttcacagttctagtgtctcctcattacgtgaattcaagctacgatcactatctcaactcctacataaacatcagaatgctacaaaactatgcacaaaaacaaaagctacatctaatacgtgaatcaattactctcatcacaagaaagaagatttcaatcaccgtcgagaaggaggattcagttaattgaatcaaagttccgatcaaactcgaagactggtgagcacgaggacgacgaagaagagtgtctcgaagatacaacaagcaagaaatctactgagtgacctcctgaagttattggcgcgattgagagaatcaatccgaattaatttcggggaaaaagataaattagatactaagcgatgggcttgggctgggctaagaaacaggtggcaattgggctggaggaccccgcgattcatagcttccgatagcccaaaaaaaaacggataacatatttatcgggtatttgaatttcagtgaaataagatattttctttttgttaggaaaattttagaaaataatggaaattaaatagcgattatgttacaagatacgatcagcatcgggcagtgcaaaatgctatagcttcccaagatttgatccttttgggttatctcctaatgacaattagtttaggattttgaaacttatattaatactattatccgacaacacttgtttcagcttcttattttaacattttttgtttttttctattcttcttcccatcagcattttctttttaaaaaattgaatactttaactttttaaaaatttcacaatgatcagatgatattatggaagatctcaagagttaaatgtatccatcttggggcattaaaaccggtgtacgggatgataaatacagactttatatcatatgatagctcagtaattcatatttatcacgttgctaaaaaaattataaggtactagtagtcaacaaaatcaattaaagagaaagaaagaaacgcatgtgaagagagtttacaactggaaaagtaaaataaaaattaacgcatgttgaatgctgacatgtcagtatgtccatgaatccacgtatcaagcgccattcatcgatcgtcttcctctttctaaatgaaaacaacttcacacatcacaacaaacaatacacacaagaccccctctctctcgttgtctctctgccagcgaccaaatcgaagcttgagaagaacaagaaggggtcaaaccatgggaaaaggatctgagggaagatctgctgctagagagatgactgctgaggctaacggagataagagaaagaccatcctcattgagggagtgttgtacgatgctaccaacttcaaacacccaggaggttccattattaacttcctcaccgagggagaagctggagttgatgctacccaagcttacagagagttccatcagagatccggaaaggctgataagtacctcaagtccctcccaaagttggatgcttctaaggtggagtctaggttctctgctaaggagcaggctagaagggacgctatgaccagggattacgctgctttcagagaggagttggttgctgagggatacttcgatccatctatcccacacatgatctacagagtggtggagattgtggctttgttcgctttgtctttctggttgatgtctaaggcttctccaacctctttggttttgggagtggtgatgaacggaatcgctcaaggaagatgcggatgggttatgcacgagatgggacacggatctttcactggagttatctggctcgatgataggatgtgcgagttcttctacggagttggatgtggaatgtctggacactactggaagaaccagcactctaagcaccacgctgctccaaacagattggagcacgatgtggatttgaacaccttgccactcgttgctttcaacgagagagttgtgaggaaggttaagccaggatctttgttggctttgtggctcagagttcaggcttatttgttcgctccagtgtcttgcttgttgatcggattgggatggaccttgtacttgcacccaagatatatgctcaggaccaagagacacatggagtttgtgtggatcttcgctagatatatcggatggttctccttgatgggagctttgggatattctcctggaacttctgtgggaatgtacctctgctctttcggacttggatgcatctacatcttcctccaattcgctgtgtctcacacccacttgccagttaccaacccagaggatcaattgcactggcttgagtacgctgctgatcacaccgtgaacatctctaccaagtcttggttggttacctggtggatgtctaacctcaacttccaaatcgagcaccacttgttcccaaccgctccacaattcaggttcaaggagatctctccaagagttgaggctctcttcaagagacacaacctcccttactacgatttgccatacacctctgctgtttctactaccttcgctaacctctactctgttggacactctgttggagctgataccaagaagcaggattgatgattaatgaataattgattgtacatactatattttttgtttaccttgtgttagtttaatgttcagtgtcctctctttattgtggcacgtctctttgttgtatgttgtgtctatacaaagttgaaataatggaaagaaaaggaagagtgtaatttgttttgttttaagtgtttataaatatatatatataggtcatttagatagttctaggtttctataaaactctctctctggaagtagaatctgtttttgagaggatccagttgcctactaatctcccccaaaacccttcaagcttaaccttcctcttcacaacaacagaggaaacacatctcttgagctctgagttctcttctttgagcatgtctatcgctaaactcatctgccttatagcttccctcttctcttcatctctctctctcaccatttcgctgtaaaacttattctcctccctcagcctctctatctcttccttcagcatctcacaattcccaccataatcgactgaggatgattcaccgtcatcaacttcagactcagcgttgtagtcgtcatgagtctcacaagccttggaccaagaagactcatcatcgcaagttgatgatttatcatgatgcttctctgagccgtgtttgctacctagagtcagctgagcttagctaacgctagctagtgtcagctgacgttacgtaaggctaactagcgtcacgtgaccttacgtaacgctacgtaggctcagctgagcttagctaaccctagctagtgtcacgtgagcttacgctactatagaaaatgtgttatatcgacatgaccagacaaaggggcaacagttaacaaaacaattaattctttcatttgagattaaggaaggtaaggtactaaaaagattaaaaaaaatgagcttatctctttgtttctgtaataataatataagtgtgataaacttttaatataataattgtaattaggttttctacagatgagcaccactcagagacaagataagaagaaaacaattttgttaaacatgattatagaaacttttagttaagtcttgaagtatcaatataacaaaaaaaagtacacacgactatgacaataaacccactaccgtcaggttatcatttcgatgaaatgttttgatatcattaaatataacagtcacaaaaaatcatctaattataacaatataacttatacatatatttaactaaaaacttagagtttttgtaatgattctaattgatgattagagtttatagaaatacaattaaataaaaaatataattttaaaaaaacatagtaaagtcaatgagatcctctctgacctcagtgatcatttagtcatgtatgtacaacaatcattgttcatcacatgactgtaaaataaataaggataaacttgggaatatatataatatattgtattaaataaaaaagggaaatacaaatatcaattttagattcccgagttgacacaactcaccatgcacgctgccacctcagctcccagctctcgtcacatgtctcatgtcagttaggtctttggtttttagtctttgacacaactcgccatgcatgttgccacgtgagctcgttcctcttcccatgatctcaccactgggcatgcatgctgccacctcagctggcacctcttctctatatgtccctagaggccatgcacagtgccacctcagcactcctctcagaacccatacgtacctgccaatcggcttctctccataaatatctatttaaattataactaattatttcatatacttaattgatgacgtggatgcattgccatcgttgtttaataattgttaattacgacatgataaataaaatgaaagtaaaaagtacgaaagattttccatttgttgttgtataaatagagaagtgagtgatgcataatgcatgaatgcatgaccgcgccaccatgactgttggatacgacgaggagatcccattcgagcaagttagggctcataacaagccagacgacgcttggtgtgctattcacggacacgtgtacgacgttaccaagttcgcttcagttcacccaggaggagatattatcttgctcgctgctggaaaggaagctactgtcctctacgagacctaccatgttagaggagtgtctgacgctgtgctcagaaagtacagaataggaaagttgccagacggacaaggaggagctaacgagaaggagaagagaaccttgtctggattgtcctctgcttcttactacacctggaactccgatttctacagagtgatgagggagagagttgtggctagattgaaggagagaggaaaggctagaagaggaggatacgaactctggatcaaggctttcttgctccttgttggattctggtcctctctttactggatgtgcaccctcgatccatctttcggagctatcttggctgctatgtctttgggagtgttcgctgcttttgttggaacctgcatccaacacgatggaaaccacggagctttcgctcaatctagatgggttaacaaggtggcaggatggactttggatatgatcggagcttctggaatgacttgggagttccaacacgtgttgggacaccacccatacactaacttgatcgaggaggagaacggattgcaaaaggtgtccggaaagaagatggataccaagttggctgatcaagagtctgatccagatgtgttctccacctacccaatgatgagattgcacccttggcaccagaagaggtggtatcacaggttccagcacatctacggacctttcatcttcggattcatgaccatcaacaaggtggtgactcaagatgttggagtggtgttgagaaagagactcttccaaatcgatgctgagtgcagatatgcttccccaatgtacgttgctaggttctggattatgaaggctttgaccgtgttgtatatggttgctttgccttgttatatgcaaggaccttggcacggattgaaactcttcgctatcgctcacttcacttgcggagaggttttggctaccatgttcatcgtgaaccacattatcgagggagtgtcttacgcttctaaggatgctgttaagggaactatggctccaccaaagactatgcacggagtgaccccaatgaacaacactagaaaggaggttgaggctgaggcttctaagtctggagctgtggttaagtctgtgccattggatgattgggctgctgttcagtgccaaacctctgtgaactggtctgttggatcttggttttggaaccacttctctggaggactcaaccaccaaatcgagcaccacctcttcccaggattgtctcacgagacctactaccacatccaagacgtggttcaatctacctgtgctgagtacggagttccataccaacacgagccatctttgtggactgcttactggaagatgctcgaacaccttagacaattgggaaacgaggagactcacgagtcatggcagagagctgcttgattaatgaactaagactcccaaaaccaccttccctgtgacagttaaaccctgcttatacctttcctcctaataatgttcatctgtcacacaaactaaaataaataaaatgggagcaataaataaaatgggagctcatatatttacaccatttacactgtctattattcaccatgccaattattacttcataattttaaaattatgtcatttttaaaaattgcttaatgatggaaaggattattataagttaaaagtataacatagataaactaaccacaaaacaaatcaatataaactaacttactctcccatctaatttttatttaaatttctttacacttctcttccatttctatttctacaacattatttaacatttttattgtatttttcttactttctaactctattcatttcaaaaatcaatatatgtttatcaccacctctctaaaaaaaactttacaatcattggtccagaaaagttaaatcacgagatggtcattttagcattaaaacaacgattcttgtatcactatttttcagcatgtagtccattctcttcaaacaaagacagcggctatataatcgttgtgttatattcagtctaaaacaactagctagcctcagctgacgttacgtaacgctaggtagcgtcacgtgacgttagctaacgctaggtagcgtcagctgagcttacgtaagcgccacgggcaggacatagggactactacaagcatagtatgcttcagacaaagagctaggaaagaactcttgatggaggttaagagaaaaaagtgctagaggggcatagtaatcaaacttgtcaaaaccgtcatcatgatgagggatgacataatataaaaagttgactaaggtcttggtagtactctttgattagtattatatattggtgagaacatgagtcaagaggagacaagaaaccgaggaaccatagtttagcaacaagatggaagttgcaaagttgagctagccgctcgattagttacatctcctaagcagtactacaaggaatggtctctatactttcatgtttagcacatggtagtgcggattgacaagttagaaacagtgcttaggagacaaagagtcagtaaaggtattgaaagagtgaagttgatgctcgacaggtcaggagaagtccctccgccagatggtgactaccaaggggttggtatcagctgagacccaaataagattcttcggttgaaccagtggttcgaccgagactcttagggtgggatttcactgtaagatttgtgcattttgttgaatataaattgacaattttttttatttaattatagattatttagaatgaattacatatttagtttctaacaaggatagcaatggatgggtatgggtacaggttaaacatatctattacccacccatctagtcgtcgggttttacacgtacccacccgtttacataaaccagaccggaattttaaaccgtacccgtccgttagcgggtttcagatttacccgtttaatcgggtaaaacctgattactaaatatatattttttatttgataaacaaaacaaaaatgttaatattttcatattggatgcaattttaagaaacacatattcataaatttccatatttgtaggaaaataaaaagaaaaatatattcaagaacacaaatttcaccgacatgacttttattacagagttggaattagatctaacaattgaaaaattaaaattaagatagaatatgttgaggaacatgacatagtataatgctgggttacccgtcgggtaggtatcgaggcggatactactaaatccatcccactcgctatccgataatcactggtttcgggtatacccattcccgtcaacaggcctttttaaccggataatttcaacttatagtgaatgaattttgaataaatagttagaataccaaaatcctggattgcatttgcaatcaaattttgtgaaccgttaaattttgcatgtacttgggatagatataatagaaccgaattttcattagtttaatttataacttactttgttcaaagaaaaaaaatatctatccaatttacttataataaaaaataatctatccaagttacttattataatcaacttgtaaaaaggtaagaatacaaatgtggtagcgtacgtgtgattatatgtgacgaaatgttatatctaacaaaagtccaaattcccatggtaaaaaaaatcaaaatgcatggcaggctgtttgtaaccttggaataagatgttggccaattctggagccgccacgtacgcaagactcagggccacgttctcttcatgcaaggatagtagaacaccactccacccacctcctatattagacctttgcccaaccctccccaactttcccatcccatccacaaagaaaccgacatttttatcataaatcagggtttcgtttttgtttcatcgataaactcaaaggtgatgattttagggtcttgtgagtgtgcttttttgtttgattctactgtagggtttatgttctttagctcataggttttgtgtatttcttagaaatgtggcttctttaatctctgggtttgtgactttttgtgtggtttctgtgtttttcatatcaaaaacctattttttccgagtttttttttacaaattcttactctcaagcttgaatacttcacatgcagtgttcttttgtagattttagagttaatgtgttaaaaagtttggatttttcttgcttatagagcttcttcactttgattttgtgggtttttttgttttaaaggtgagatttttgatgaggtttttgcttcaaagatgtcacctttctgggtttgtcttttgaataaagctatgaactgtcacatggctgacgcaattttgttactatgtcatgaaagctgacgtttttccgtgttatacatgtttgcttacacttgcatgcgtcaaaaaaattggggctttttagttttagtcaaagattttacttctcttttgggatttatgaaggaaagttgcaaactttctcaaattttaccatttttgctttgatgtttgtttagattgcgacagaacaaactcatatatgttgaaatttttgcttggttttgtataggattgtgtcttttgcttataaatgttgaaatctgaactttttttttgtttggtttctttgagcaggagataaggcgcaccaccatggcttctacatctgctgctcaagacgctgctccttacgagttcccttctctcactgagatcaagagggctcttccttctgagtgtttcgaggcttctgttcctctttctctctactacaccgctagatctcttgctcttgctggatctctcgctgttgctctctcttacgctagagctttgcctcttgttcaggctaacgctcttcttgatgctactctctgcactggatacgttcttctccagggaatcgttttctggggattcttcaccgttggtcacgattgtggacacggagctttctctagatctcacgtgctcaacttctctgttggaaccctcatgcactctatcatccttacccctttcgagtcttggaagctctctcacagacaccaccacaagaacaccggaaacatcgataaggacgagatcttctaccctcaaagagaggctgattctcaccctgtttctagacaccttgtgatgtctcttggatctgcttggttcgcttaccttttcgctggattccctcctagaaccatgaaccacttcaacccttgggaggctatgtatgttagaagagtggctgctgtgatcatctctctcggagttcttttcgctttcgctggactctactcttacctcaccttcgttcttggattcaccactatggctatctactacttcggacctctcttcatcttcgctaccatgcttgttgttaccactttcctccaccacaacgatgaggagacaccttggtacgctgattctgagtggacttacgtgaagggaaacctctcttctgtggacagatcttacggtgctctcatcgacaaccttagccacaacatcggaactcaccagatccaccacctcttccctatcatccctcactacaagctcaacgatgctactgctgctttcgctaaggctttccctgagcttgttaggaaaaacgctgctcctatcatcccaactttcttcaggatggctgctatgtacgctaagtacggagttgttgacactgatgctaagaccttcactctcaaggaggctaaggctgctgctaagactaagtcatcttgatgattaatgaaggccgcagatatcagatctggtcgacctagaggatccccggccgcaaagataataacaaaagcctactatataacgtacatgcaagtattgtatgatattaatgtttttacgtacgtgtaaacaaaaataattacgtttgtaacgtatggtgatgatgtggtgcactaggtgtaggccttgtattaataaaaagaagtttgttctatatagagtggtttagtacgacgatttatttactagtcggattggaatagagaaccgaattcttcaatccttgcttttgatcaagaattgaaaccgaatcaaatgtaaaagttgatatatttgaaaaacgtattgagcttatgaaaatgctaatactctcatctgtatggaaaagtgactttaaaaccgaacttaaaagtgacaaaaggggaatatcgcatcaaaccgaatgaaaccgatctacgtaggctcagctgagcttacctaaggctacgtaggctcacgtgacgttacgtaaggctacgtagcgtcacgtgagcttacctaactctagctagcctcacgtgaccttagctaacactaggtagcgtcagcttagcagatatttggtgtctaaatgtttattttgtgatatgttcatgtttgaaatggtggtttcgaaaccagggacaacgttgggatctgatagggtgtcaaagagtattatggattgggacaatttcggtcatgagttgcaaattcaagtatatcgttcgattatgaaaattttcgaagaatatcccatttgagagagtctttacctcattaatgtttttagattatgaaattttatcatagttcatcgtagtctttttggtgtaaaggctgtaaaaagaaattgttcacttttgttttcgtttatgtgaaggctgtaaaagattgtaaaagactattttggtgttttggataaaatgatagtttttatagattcttttgcttttagaagaaatacatttgaaattttttccatgttgagtataaaataccgaaatcgattgaagatcatagaaatattttaactgaaaacaaatttataactgattcaattctctccatttttatacctatttaaccgtaatcgattctaatagatgatcgattttttatataatcctaattaaccaacggcatgtattggataattaaccgatcaactctcacccctaatagaatcagtattttccttcgacgttaattgatcctacactatgtaggtcatatccatcgttttaatttttggccaccattcaattctgtcttgcctttagggatgtgaatatgaacggccaaggtaagagaataaaaataatccaaattaaagcaagagaggccaagtaagataatccaaatgtacacttgtcattgccaaaattagtaaaatactcggcatattgtattcccacacattattaaaataccgtatatgtattggctgcatttgcatgaataatactacgtgtaagcccaaaagaacccacgtgtagcccatgcaaagttaacactcacgaccccattcctcagtctccactatataaacccaccatccccaatctcaccaaacccaccacacaactcacaactcactctcacaccttaaagaaccaatcaccaccaaaaaaagttctttgctttcgaagttgccgcaacctaaacaggtttttccttcttctttcttcttattaactacgaccttgtcctttgcctatgtaaaattactaggttttcatcagttacactgattaagttcgttatagtggaagataaaatgccctcaaagcattttgcaggatatctttgatttttcaaagatatggaactgtagagtttgatagtgttcttgaatgtggttgcatgaagtttttttggtctgcatgttattttttcctcgaaatatgttttgagtccaacaagtgattcacttgggattcagaaagttgttttctcaatatgtaacagtttttttctatggagaaaaatcatagggaccgttggttttggcttctttaattttgagctcagattaaacccattttacccggtgttcttggcagaattgaaaacagtacgtagtaccgcgcctaccatgccacctagtgctgctagtgaaggtggtgttgctgaacttagagctgctgaagttgctagctacactagaaaggctgttgacgaaagacctgacctcactatagttggtgacgctgtttacgacgctaaggcttttagggacgagcaccctggtggtgctcacttcgttagccttttcggaggtagggacgctactgaggcttttatggaatatcaccgtagagcttggcctaaggctaggatgtctaagttcttcgttggttcacttgacgctagcgagaagcctactcaagctgattcagcttaccttagactttgcgctgaggttaacgctcttttgcctaagggtagcggaggattcgctcctcctagctactggcttaaggctgctgctcttgttgttgctgctgttagtatagagggttatatgctccttaggggtaagacccttttgcttagcgttttccttggactcgtgttcgcttggataggacttaatattcagcacgacgctaatcacggtgctcttagtagacactcagtgattaactactgcctcggttacgctcaggattggataggtggtaatatggtgctttggcttcaagagcacgttgtgatgcaccacctccacactaacgacgttgacgctgatcctgatcaaaaggctcacggtgttcttagacttaagcctactgacggttggatgccttggcacgcacttcaacaactctatatccttcctggtgaggctatgtacgcttttaagcttcttttcttggacgcccttgagcttcttgcttggaggtgggagggtgagaagattagccctcttgctagagctttgttcgctcctgctgttgcttgtaagcttggattctgggctagattcgttgctctccctctctggcttcaacctactgttcacactgctttgtgtatctgtgctactgtgtgtactggtagcttctacctcgccttcttcttctttatctctcacaacttcgacggtgttggtagcgttggacctaagggatcacttcctagatcagctactttcgttcaacgtcaggttgagactagctctaacgttggtggttactggcttggagttcttaacggtggacttaactttcagatagagcaccacttgttccctaggcttcaccactcttactacgctcaaatagctcctgtggttaggactcacatagagaagctcggttttaagtaccgtcacttccctaccgttggatctaaccttagctcaatgcttcagcatatgggtaagatgggaactagacctggtgctgagaagggtggtaaggctgagtagtgattaatgaataattgattgctgctttaatgagatatgcgagacgcctatgatcgcatgatatttgctttcaattctgttgtgcacgttgtaaaaaacctgagcatgtgtagctcagatccttaccgccggtttcggttcattctaatgaatatatcacccgttactatcgtatttttatgaataatattctccgttcaatttactgattgtctacgtagcgtcacctgacgttacgtaaggctacctaggctcacgtgacgttacgtaacgctacgtagcgtcaggtgaggttagctaacgctagctagcctcacctgacgttaggtaaggctacgtagcgtcacctgagattagctaagcctacctagactcacgtgaccttaggtaacgctacgtagcgtcaaagctttacaacgctacacaaaacttataaccgtaatcaccattcattaacttaactactatcacatgcattcatgaattgaaacgagaaggatgtaaatagttgggaagttatctccacgttgaagagatcgttagcgagagctgaaagaccgagggaggagacgccgtcaacacggacagagtcgtcgaccctcacatgaagtaggaggaatctccgtgaggagccagagagacgtctttggtcttcggtttcgatccttgatctgacggagaagacgagagaagtgcgactggactccgtgaggaccaacagagtcgtcctcggtttcgatcgtcggtattggtggagaaggcggaggaatctccgtgacgagccagagagatgtcgtcggtcttcggtttcgatccttgatctgacggagaagacgagagaagtgcgacgagactccgtgaggaccaacagagttgtcctcggtttcgatcgtcggtttcggcggagaaggcggaggaatctccgtgaggagccagagagacgtcgttggtcttcggtttcgatccttgatctgttggagaagacgagacaagtgggacgagactcaacgacggagtcagagacgtcgtcggtcttcggtttcggccgagaaggcggagtcggtcttcggtttcggccgagaaggcggaggagacgtcttcgatttgggtctctcctcttgacgaagaaaacaaagaacacgagaaataatgagaaagagaacaaaagaaaaaaaaataaaaataaaaataaaatttggtcctcttatgtggtgacacgtggtttgaaacccaccaaataatcgatcacaaaaaacctaagttaaggatcggtaataacctttctaattaattttgatttatattaaatcactctttttatttataaaccccactaaattatgcgatattgattgtctaagtacaaaaattctctcgaattcaatacacatgtttcatatatttagccctgttcatttaatattactagcgcatttttaatttaaaattttgtaaacttttttggtcaaagaacatttttttaattagagacagaaatctagactctttatttggaataatagtaataaagatatattaggcaatgagtttatgatgttatgtttatatagtttatttcattttaaattgaaaagcattatttttatcgaaatgaatctagtatacaatcaatatttatgttttttcatcagatactttcctattttttggcacctttcatcggactactgatttatttcaatgtgtatgcatgcatgagcatgagtatacacatgtcttttaaaatgcatgtaaagcgtaacggaccacaaaagaggatccatacaaatacatctcatcgcttcctctacta

SEQ ID NO: 309 - DNA, 20 bp, Artificial sequence
  LBFDAU Locus 2 RB junction region
caccctggctttggggtgag

SEQ ID NO: 310 - DNA, 20 bp, Artificial sequence
  LBFDAU Locus 2 LB junction region
tcctctactattctccgaca

SEQ ID NO: 311 - DNA, 5600 bp, Artificial sequence; identical to SEQ ID NO: 239
  LBFDAU Locus 2 flanking sequence up to and including the right border of the T-DNA

SEQ ID NO: 312 - DNA, 1321 bp, Artificial sequence; identical to SEQ ID NO: 240
  LBFDAU Locus 2 flanking sequence up to and including the left border of the T-DNA

SEQ ID NO: 313 - DNA, 23 bp, Artificial sequence
  LBFDAU Locus 2_Forward primer
cactgagcatggtgcttaaacac

SEQ ID NO: 314 - DNA, 29 bp, Artificial sequence
  LBFDAU Locus 2_Reverse primer
agagcgagagagaggaagtaggtatataa

SEQ ID NO: 315 - DNA, 19 bp, Artificial sequence
  LBFDAU locus 2_Probe
ctggtgagttctagtactt

SEQ ID NO: 316 - DNA, 19 bp, Artificial sequence
  Primer for determining zygosity of LBFLFK Locus 1
agaagtgtacgcgacgaga

SEQ ID NO: 317 - DNA, 21 bp, Artificial sequence
  Primer for determining zygosity of LBFLFK Locus 1
tcaggagcgagaatgcgaaag

SEQ ID NO: 318 - DNA, 21 bp, Artificial sequence
  Primer for determining zygosity of LBFLFK Locus 2
acccatacatacgcataagtg

SEQ ID NO: 319 - DNA, 19 bp, Artificial sequence
  Primer for determining zygosity of LBFLFK Locus 2
aatatatgggctacattga

SEQ ID NO: 320 - DNA, 18 bp, Artificial sequence
  Primer for determining zygosity of LBFDAU Locus 1
ggcaggcgtgatcttatt

SEQ ID NO: 321 - DNA, 21 bp, Artificial sequence
  Primer for determining zygosity of LBFDAU Locus 1
cataatttgcagtcgctgatt

SEQ ID NO: 322 - DNA, 21 bp, Artificial sequence
  Primer for determining zygosity of LBFDAU Locus 2
agataacgatacatccacgaa

SEQ ID NO: 323 - DNA, 21 bp, Artificial sequence
  Primer for determining zygosity of LBFDAU Locus 2
cgaacataacagagcgagaga

SEQ ID NO: 324 - DNA, 1197 bp, Artificial Sequence
  d12Des(Ps) on LBFLFK Locus 1
atggctattttgaaccctgaggctgattctgctgctaacctcgctactgattctgaggctaagcaaagacaattggctgaggctggatacactcacgttgagggtgctcctgctcctttgcctttggagttgcctcacttctctctcagagatctcagagctgctattcctaagcactgcttcgagagatctttcgtgacctccacctactacatgatcaagaacgtgttgacttgcgctgctttgttatacgctgctaccttcattgatagagctggagctgctgcttatgttttgtggcctgtgtactggttcttccagggatcttacttgactggagtgtgggttatcgctcacgagtgtggacaccaggcttattgctcttctgaggtggtgaacaacttgattggactcgtgttgcactctgctttgttggtgccttaccactcttggagaatctctcacagaaagcaccactccaacactggatcttgcgagaacgatgaggttttcgttcctgtgaccagatctgtgttggcttcttcttggaacgagaccttggaggattctcctctctaccaactctaccgtatcgtgtacatgttggttgttggatggatgcctggatacctcttcttcaacgctactggacctactaagtactggggaaagtctaggtctcacttcaacccttactccgctatctatgctgatagggagaggtggatgatcgtgctctccgatattttcttggtggctatgttggctgttttggctgctttggtgcacactttctccttcaacacgatggtgaagttctacgtggtgccttacttcattgtgaacgcttacttggtgttgattacctacctccaacacaccgatacctacatccctcacttcagagagggagagtggaattggttgagaggagctttgtgcactgtggatagatcatttggtccattcctcgattctgtggtgcatagaatcgtggatacccacgtttgccaccatatcttctccaagatgcctttctatcactgcgaggaggctaccaacgctattaagcctctcctcggaaagttctacttgaaggatactactcctgttcctgttgctctctggagatcttacacccactgcaagttcgttgaggatgatggaaaggtggtgttctacaagaacaagttatag

SEQ ID NO: 325 - protein, 398 aa, Artificial Sequence
  d12Des(Ps) on LBFLFK Locus 1
MAILNPEADSAANLATDSEAKQRQLAEAGYTHVEGAPAPLPLELPHFSLRDLRAAIPKHCFERSFVTSTYYMIKNVLTCAALLYAATFIDRAGAAAYVLWPVYWFFQGSYLTGVWVIAHECGHQAYCSSEVVNNLIGLVLHSALLVPYHSWRISHRKHHSNTGSCENDEVFVPVTRSVLASSWNETLEDSPLYQLYRIVYMLVVGWMPGYLFFNATGPTKYWGKSRSHFNPYSAIYADRERWMIVLSDIFLVAMLAVLAALVHTFSFNTMVKFYVVPYFIVNAYLVLITYLQHTDTYIPHFREGEWNWLRGALCTVDRSFGPFLDSVVHRIVDTHVCHHIFSKMPFYHCEEATNAIKPLLGKFYLKDTTPVPVALWRSYTHCKFVEDDGKVVFYKNKL

SEQ ID NO: 326 - DNA, 1338 bp, Artificial Sequence
  d4Des(Pl) on LBFLFK Locus 2
atgccacctagtgctgctagtgaaggtggtgttgctgaacttagagctgctgaagttgctagctacactagaaaggctgttgacgaaagacctgacctcactatagttggtgacgctgtttacgacgctaaggcttttagggacgagcaccctggtggtgctcacttcgttagccttttcggaggtagggacgctactgaggcttttatggaatatcaccgtagagcttggcctaaggctaggatgtctaagttcttcgttggttcacttgacgctagcgagaagcctactcaagctgattcatcttaccttagactttgcgctgaggttaacgctcttttgcctaagggtagcggaggattcgctcctcctagctactggcttaaggctgctgctcttgttgttgctgctgttagtatagagggttatatgctccttaggggtaagacccttttgcttagcgttttccttggactcgtgttcgcttggataggacttaatattcagcacgacgctaatcacggtgctcttagtagacactcagtgattaactactgcctcggttacgctcaggattggataggtggtaatatggtgctttggcttcaagagcacgttgtgatgcaccacctccacactaacgacgttgacgctgatcctgatcaaaaggctcacggtgttcttagacttaagcctactgacggttggatgccttggcacgcacttcaacaactctatatccttcctggtgaggctatgtacgcttttaagcttcttttcttggacgcccttgagcttcttgcttggaggtgggagggtgagaagattagccctcttgctagagctttgttcgctcctgctgttgcttgtaagcttggattctgggctagattcgttgctctccctctctggcttcaacctactgttcacactgctttgtgtatctgtgctactgtgtgtactggtagcttctacctcgccttcttcttctttatctctcacaacttcgacggtgttggtagcgttggacctaagggatcacttcctagatcagctactttcgttcaacgtcaggttgagactagctctaacgttggtggttactggcttggagttcttaacggtggacttaactttcagatagagcaccacttgttccctaggcttcaccactcttactacgctcaaatagctcctgtggttaggactcacatagagaagctcggttttaagtaccgtcacttccctaccgttggatctaaccttagctcaatgcttcagcatatgggtaagatgggaactagacctggtgctgagaagggtggtaaggctgagtag

SEQ ID NO: 327 - protein, 445 aa, Artificial Sequence
  d4Des(Pl) on LBFLFK Locus 2
MPPSAASEGGVAELRAAEVASYTRKAVDERPDLTIVGDAVYDAKAFRDEHPGGAHFVSLFGGRDATEAFMEYHRRAWPKARMSKFFVGSLDASEKPTQADSSYLRLCAEVNALLPKGSGGFAPPSYWLKAAALVVAAVSIEGYMLLRGKTLLLSVFLGLVFAWIGLNIQHDANHGALSRHSVINYCLGYAQDWIGGNMVLWLQEHVVMHHLHTNDVDADPDQKAHGVLRLKPTDGWMPWHALQQLYILPGEAMYAFKLLFLDALELLAWRWEGEKISPLARALFAPAVACKLGFWARFVALPLWLQPTVHTALCICATVCTGSFYLAFFFFISHNFDGVGSVGPKGSLPRSATFVQRQVETSSNVGGYWLGVLNGGLNFQIEHHLFPRLHHSYYAQIAPVVRTHIEKLGFKYRHFPTVGSNLSSMLQHMGKMGTRPGAEKGGKAE

SEQ ID NO: 328 - protein, 398 aa, Artificial Sequence
  Consensus
  misc_feature (94)..(94): Xaa can be any proteinogenic amino acid
  misc_feature (186)..(186): Xaa can be any proteinogenic amino acid
MAILNPEAESAAKVASLSEAKQRELAEAGYKHVEGAPAPLPLDLPHFSLRDLRAAIPKHCFERSFITSTYYMIKNLLTCAALFYAATYIDQTGXFAYLLWPVYWFFQGSYLTGIWVIAHECGHQAYCSSEVVNNLIGLVLHSALLVPYHSWRISHRKHHSNTGSCENDEVFVPVTRSVIASSWDEXLEDSPLYQLYRIVYMLVVGWMPGYLFFNATGPTKYWGKSRSHFNPYSAIYSDRERWMIVLSDIFLVLMIGVLATLVYTFSFYTMLKFYVVPYFIVNAYLVLITYLQHTDTYIPHFRDSEWNWLRGALCTVDRSFGPYLDSVVHRIVDTHVCHHIFSKMPFYHCEEATNAIKPLLGKFYLKDDTPVPIALWRSYTHCKFVEDDGKIVFYKNKL

SEQ ID NO: 329 - protein, 398 aa, Phytophthora sojae; identical to SEQ ID NO: 266
  MISC_FEATURE: G5A275_PHYSP-Phytophthora_sojae

SEQ ID NO: 330 - protein, 398 aa, Phytophthora ramorum
  MISC_FEATURE: H3G9L1_PHYRM-Phytophthora_ramorum
MAILNPEADSAAKVASDSEAKQRQLAEAGYKHVEGAPAPLPLELPHFSLRELRAAIPKHCFERSFVTSTYYAIKNMLTCAALFYAASYIDQTGAAAYLLWPVYWFFQGSYLTGIWVVAHECGHQAYCSSEVVNNIIGLVLHSALLVPYHSWRISHRKHHSNTGSCENDEVFVPVTRSVAASSWDETLEDSPLYQLYRIVYMLVVGWMPGYLFFNATGPTKYWGKPRSHFNPYSAIYSDRERWMIVLSDIFLIVALSTLAVLVHTFSLFTMVKFYVVPYFVVNAYLVLITFLQHTDTYIPHFREGEWSWLRGALCTVDRSFGKYLDSVVHRIVDTHVCHHIFSKMPFYHCEEATNAIKPLLGKFYLKDTTPVPMALWRSYTYCKFVEDDGNVVFYKNKL

SEQ ID NO: 331 - protein, 398 aa, Phytophthora infestans
  MISC_FEATURE: G4XUM4_PHYIN-Phytophthora_infestans
MAILNPEAESAAKVATLSEAKQRELAEAGYKHVEGAPAPLPLDLPHFSLRDLRAAIPKHCFERSFITSTYYMIKNLLTCAALFYAATYIDQTGSFAYLLWPVYWFFQGSYLTGIWVVAHECGHQAYCSSEVVNNMIGLVLHSTLLVPYHSWRISHRKHHSNTGSCENDEVFVPVTRSVIASSWDETLEDSPLYQLYRIVYMLVVGWMPGYLFFNATGPSKYLGKSRSHFNPYSSIYSDRERWMIVLSDIFLVLMIGALVTLVYTFSFYTMLKFYVVPYFIVNAYLVLITYLQHTDTYIPHFRDSEWNWLRGALCTVDRSFGPYLDSVVHRIVDTHICHHIFSKMPFYHCEEATNAIKPLLGKFYLKDDTPVPIALWRSYIHCKFVEDDGKIVFYKNKL

SEQ ID NO: 332 - protein, 398 aa, Hyaloperonospora arabidopsidis
  MISC_FEATURE: M4BXW8_HYAAE-Hyaloperonospora_arabidopsidis
MAILNPDSESPTKQVADSEAKQRQLAEAGYKHVEGCPAPLPLELPHFSLRDLRAATPEHCFERSFVTSMYHLVKNLLYCGALLYVATRLDDLGAIAYLLWPVYWFFQGSYLTGVWVIAHECGHQSFCSSETVNNLIGLVLHSALLVPYHSWRISHRKHHSNTGSCENDEVFVPVTRSAIKSSWNEVLEDSPLYQLYRIAFMLVVGWMPGYLCFNATGPSKYWGKARSHFNPFSTLYADRERWLIVLSDVSLVLVLAGLAGLVHTLSLYTMVKLYFAPYLIVNVYLVLITFLQHTDTYIPHFREGEWTWLRGALCTVDRSFGPYLDSVLHHIVDTHVVHHIFSKMPFYHCEEATKAIKPLLGKFYLKDTTPFPLAMWRSYKHCKFVEDDGKIVFYKNKL

SEQ ID NO: 333 - protein, 398 aa, Phytophthora parasitica
  MISC_FEATURE: W2PDL4_PHYPN-Phytophthora_parasitica
MAILNPEAESAAKVASLSEAKQRELAEAGYKHVEGAPAPLPLDLPHFSLRDLRAAIPKHCFERSFITSTYYMIKNLLTCAALFYAATYIDQTGNFAYLLWPVYWFFQGSYLTGIWVIAHECGHQAYCSSEVVNNLIGLVLHSALLVPYHSWRISHRKHHSNTGSCENDEVFVPVTRSVIASSWDENLEDSPLYQLYRIVYMLVVGWMPGYLFFNATGPTKYWGKSRSHFNPYSAIYSDRERWMIVLSDIFLVLVIGVLATLVYTFSFYTMLKFYVVPYFIVNAYLVLITYLQHTDTYIPHFRDSEWNWLRGALCTVDRSFGPYLDSVVHRIVDTHVCHHIFSKMPFYHCEEATNAIKPLLGKFYLKDDTPVPIALWRSYTHCKFVEDDGKIVFYKNKL

SEQ ID NO: 334 - protein, 398 aa, Phytophthora parasitica
  MISC_FEATURE: W2LW72_PHYPR-Phytophthora_parasitica
MAILNPEAESAAKVASLSEAKQRELAEAGYKHVEGAPAPLPLDLPHFSLRDLRAAIPKHCFERSFITSTYYMIKNLLTCAALFYAATYIDQTGNFAYLLWPVYWFFQGSYLTGIWVIAHECGHQAYCSSEVVNNLIGLVLHSALLVPYHSWRISHRKHHSNTGSCENDEVFVPVTRSVIASSWDENLEDSPLYQLYRIVYMLVVGWMPGYLFFNATGPTKYWGKSRSHFNPYSAIYSDRERWMIVLSDIFLVLMIGVLATLVYTFSFYTMLKFYVVPYFIVNAYLVLITYLQHTDTYIPHFRDSEWNWLRGALCTVDRSFGPYLDLVVHRIVDTHVCHHIFSKMPFYHCEEATNAIKPLLGKFYLKDDTPVPIALWRSYTHCKFVEDDGKIVFYKNKL

SEQ ID NO: 335 - protein, 398 aa, Phytophthora parasitica
  MISC_FEATURE: W2ZYI2_PHYPR-Phytophthora_parasitica
MAILNPEAESAAKVASLSEAKQRELAEAGYKHVEGAPAPLPLDLPHFSLRDLRAAIPKHCFERSFITSTYYMIKNLLTCAALFYAATYIDQTGNFTYLLWPVYWFFQGSYLTGIWVIAHECGHQAYCSSEVVNNLIGLVLHSALLVPYHSWRISHRKHHSNTGSCENDEVFVPVTRSVIASSWDENLEDSPLYQLYRIVYMLVVGWMPGYLFFNATGPTKYWGKSRSHFNPYSAIYSDRERWMIVLSDIFLVLMIGVLATLVYTFSFYTMLKFYVVPYFIVNAYLVLITYLQHTDTYIPHFRDSEWNWLRGALCTVDRSFGPYLDSVVHRIVDTHVCHHIFSKMPFYHCEEATNAIKPLLGKFYLKDDTPVPIALWRSYTHCKFVEDDGKIVFYKNKL

SEQ ID NO: 336 - protein, 393 aa, Saprolegnia spp.
  MISC_FEATURE: Q6UB74_9STRA-Saprolegnia
MCKGQAPSKADVFHAAGYRPVAGTPEPLPLEPPTITLKDLRAAIPAHCFERSAATSFYHLAKNLAICAGVFAVGLKLAAADLPLAAKLVAWPIYWFVQGTYFTGIWVIAHECGHQAFSASEILNDTVGIILHSLLFVPYHSWKITHRRHHSNTGSCENDEVFTPTPRSVVEAKHDHSLLEESPLYNLYGIVMMLLVGWMPGYLFFNATGPTKYAGLAKSHFNPYAAFFLPKERLSIWWSDLCFLAALYGFGYGVSVFGLLDVARHYIVPYLICNAYLVLITYLQHTDTYVPHFRGDEWNWLRGALCTVDRSFGAWIDSAIHHIADTHVTHHIFSKTPFYHAIEATDAITPLLGKYYLIDPTPIPLALWRSFTHCKYVEDDGNVVFYKRKLEEK

The invention claimed is:

1. A method for increasing total tocopherol content of a plant relative to a control plant, comprising:
    (a) providing a transgenic plant transformed with multiple expression cassettes comprising transgenes which comprise at least one polynucleotide encoding a delta-12-desaturase from *Phythophthora* species, at least one polynucleotide encoding a delta-6-desaturase from *Ostreococcus* species, at least one polynucleotide encoding a delta-6-elongase from *Physcomitrella* species or *Thalassiosira* species, and at least one polynucleotide encoding a delta-5-desaturase from *Thraustochytrium* species;
    (b) obtaining transgenic seed oil from the transgenic plant; and
    (c) measuring total tocopherol content in said transgenic seed oil,
    wherein said transgenic seed oil has increased total tocopherol content as compared to a control plant of the same species, wherein the transgenic plant is an oilseed plant of the genus *Brassica*, and wherein expression of said transgenes in said transgenic plant results in said increase in total tocopherol content in said transgenic seed oil.

2. The method according to claim 1, wherein said multiple expression cassettes further comprise a transgene which comprises at least one polynucleotide encoding an omega-3-desaturase from *Phythophthora* species or *Pythium* species, and wherein said omega-3-desaturase is expressed in said transgenic plant.

3. The method according to claim 1, wherein said multiple expression cassettes further comprise a transgene which comprises at least one polynucleotide encoding a delta-5-elongase from *Ostreococcus* species, and wherein said delta-5-elongase is expressed in said transgenic plant.

4. The method according to claim 1, wherein said multiple expression cassettes further comprises a transgene which comprises at least one polynucleotide encoding a delta-4-desaturase from *Thraustochytrium* species or *Pavlova* species, and wherein said delta-4-desaturase is expressed in said transgenic plant.

5. The method of claim 1, wherein said delta-6 elongase is from *Physcomitrella patens* or *Thalassiosira pseudonana*; said delta-12 desaturase is from *Phythophthora sojae*; and said delta-6 desaturase is from *Ostreococcus tauri*.

6. The method of claim 1, wherein said polynucleotides are present on one T-DNA or recombinant DNA construct having said multiple expression cassettes which are stably integrated in the genome of the transgenic plant.

7. The method of claim 2, wherein said omega-3-desaturase is from *Phythophthora infestans* or *Pythium irregular*.

8. The method of claim 3, wherein said delta-5 elongase is from *Ostreococcus tauri*.

9. The method of claim 4, wherein said delta-4 desaturase is from *Thraustochytrium* species or *Pavlova lutheri*.

10. The method according to claim 1, wherein said multiple expression cassettes further comprise a transgene which comprises at least one polynucleotide encoding an omega-3-desaturase from *Phythophthora* species or *Pythium* species, a transgene which comprises at least one polynucleotide encoding a delta-5-elongase from *Ostreococcus* species, and a transgene which comprises at least one polynucleotide encoding a delta-4-desaturase from *Thraustochytrium* species or *Pavlova* species.

11. The method of claim 10, wherein said delta-6 elongase is from *Physcomitrella patens* or *Thalassiosira pseudonana*; said delta-12 desaturase is from *Phythophthora sojae*; said delta-6 desaturase is from *Ostreococcus tauri*; said omega-3 desaturase is from *Pythium irregular* or *Phythophthora infestans*; said delta-5 elongase is from *Ostreococcus tauri*; and said delta-4 desaturase is from *Thraustochytrium* species or *Pavlova lutheri*.

* * * * *

UNITED STATES PATENT AND TRADEMARK OFFICE
CERTIFICATE OF CORRECTION

PATENT NO. : 10,760,089 B2
APPLICATION NO. : 15/525768
DATED : September 1, 2020
INVENTOR(S) : Carl Andre It is certified that error appears in the above-identified patent and that said Letters Patent is hereby corrected as shown below:

In the Claims

At Column 59, Line 34, "Phythophthora" should be -- Phytophthora --.

At Column 59, Line 55, "Phythophthora" should be -- Phytophthora --.

At Column 60, Line 42, "Phythophthora" should be -- Phytophthora --.

At Column 60, Line 51, "Phythophthora" should be -- Phytophthora --.

At Column 60, Line 59, "Phythophthora" should be -- Phytophthora --.

At Column 60, Line 61, "Phythophthora" should be -- Phytophthora --.

Signed and Sealed this
Twenty-third Day of April, 2024

Katherine Kelly Vidal
*Director of the United States Patent and Trademark Office*